US010563271B2

(12) United States Patent
Solem et al.

(10) Patent No.: US 10,563,271 B2
(45) Date of Patent: Feb. 18, 2020

(54) HIGH-LEVEL PRODUCTION OF DIACETYL IN A METABOLICALLY ENGINEERED LACTIC ACID BACTERIUM

(71) Applicant: Danmarks Tekniske Universitet, Kgs. Lyngby (DK)

(72) Inventors: Christian Solem, Nivå (DK); Peter Ruhdal Jensen, Gentofte (DK); Jianming Liu, Virum (DK)

(73) Assignee: Danmarks Tekniske Universitet, Kgs. Lyngby (DK)

( * ) Notice: Subject to any disclaimer, the term of this patent is extended or adjusted under 35 U.S.C. 154(b) by 0 days.

(21) Appl. No.: 15/766,461

(22) PCT Filed: Oct. 7, 2016

(86) PCT No.: PCT/EP2016/074043
§ 371 (c)(1),
(2) Date: Apr. 6, 2018

(87) PCT Pub. No.: WO2017/060455
PCT Pub. Date: Apr. 13, 2017

(65) Prior Publication Data
US 2018/0282827 A1 Oct. 4, 2018

(30) Foreign Application Priority Data

Oct. 9, 2015 (EP) .................................. 15189200
Nov. 16, 2015 (EP) .................................. 15194710
Feb. 25, 2016 (EP) .................................. 16157443

(51) Int. Cl.
*C12R 1/225* (2006.01)
*A23L 27/24* (2016.01)
*C12P 7/26* (2006.01)

(52) U.S. Cl.
CPC .............. *C12R 1/225* (2013.01); *A23L 27/25* (2016.08); *C12P 7/26* (2013.01); *C12Y 101/01004* (2013.01); *C12Y 101/01027* (2013.01); *C12Y 101/01028* (2013.01); *C12Y 101/01303* (2013.01); *C12Y 106/03* (2013.01); *C12Y 207/01069* (2013.01); *C12Y 207/01144* (2013.01); *C12Y 302/01085* (2013.01); *C12Y 401/0204* (2013.01); *C12Y 503/01026* (2013.01)

(58) Field of Classification Search
CPC .... C12Y 302/01085; C12Y 207/01144; C12Y 207/01069; C12Y 106/03; C12Y 101/01303; C12Y 503/01026; C12Y 101/01004; C12Y 401/0204; C12Y 101/01028; C12Y 101/01027; A23L 27/25; C12R 1/225; C12P 7/26
See application file for complete search history.

(56) References Cited

U.S. PATENT DOCUMENTS 6,413,765 B1  7/2002  Walfridsson et al.
2014/0113376 A1*  4/2014  Sorek ................... C12N 15/113
                                                            435/471

FOREIGN PATENT DOCUMENTS

JP          H0436180 A      2/1992

OTHER PUBLICATIONS

Broun et al., Catalytic plasticity of fatty acid modification enzymes underlying chemical diversity of plant lipids. Science, 1998, vol. 282: 1315-1317. (Year: 1998).*
Cocaign-Bousquet et al., Anaerobic sugar catabolism in Lactococcus lactis: genetic regulation and enzyme control over pathway flux. Appl Microbiol Biotechnol., 2002, vol. 60: 24-32. (Year: 2002).*
Devos et al., Practical limits of function prediction. Proteins: Structure, Function, and Genetics. 2000, vol. 41: 98-107. (Year: 2000 ).*
Oliveira et al., Modeling Lactococcus lactis using a genome-scale flux model. BMC Microbiol., 2005, vol. 5:39, pp. 1-15. (Year: 2005).*
Seffernick et al., Melamine deaminase and Atrazine chlorohydrolase: 98 percent identical but functionally different. J. Bacteriol., 2001, vol. 183 (8): 2405-2410. (Year: 2001).*
Whisstock et al., Prediction of protein function from protein sequence. Q. Rev. Biophysics., 2003, vol. 36 (3): 307-340. (Year: 2003 ).*
Witkowski et al., Conversion of b-ketoacyl synthase to a Malonyl Decarboxylase by replacement of the active cysteine with glutamine. Biochemistry, 1999, vol. 38: 11643-11650. (Year: 1999).*
Zhang et al., Production of diacetyl by metabolically engineered Enterobacter cloacae.. Nature Scientific Reports, 2015, vol. 5:9033 , pp. 1-7. (Year: 2015).*
Database EPODoc (online) European Patent Office, The Hague, NL; Meiji Milk Prod. Co. Ltd: "Enhancement of Productivity of Proliferative and Antifungal substance for Lactic Bacteria", XP002752141, DB accession No. JP-14197690-A.

(Continued)

*Primary Examiner* — Ganapathirama Raghu
(74) *Attorney, Agent, or Firm* — Casimir Jones, S.C.; Lisa V. Mueller

(57) ABSTRACT

The present invention provides a genetically modified lactic acid bacterium capable of producing diacetyl under aerobic conditions. Additionally the invention provides a method for producing diacetyl using the genetically modified lactic acid bacterium under aerobic conditions in the presence of a source of iron-containing porphyrin and a metal ion selected from $Fe^{3+}$, $Fe^{2+}$ and $Cu^{2+}$. The lactic acid bacterium is genetically modified by deletion of those genes in its genome that encode polypeptides having lactate dehydrogenase (E.C 1.1.1.27/E.C.1.1.1.28); α-acetolactate decarboxylase (E.C 4.1.1.5); water-forming NADH oxidase (E.C. 1.6.3.4); phosphotransacetylase (E.C.2.3.1.8) activity; and optionally devoid of or deleted for genes encoding polypeptides having diacetyl reductase ((R)-acetoin forming; EC:1.1.1.303); D-acetoin reductase; butanediol dehydrogenase ((R,R)-butane-2,3-diol forming; E.C. 1.1.1.4/1.1.1.-) and alcohol dehydrogenase (E.C. 1.2.1.10) activity. The invention provides for use of the genetically modified lactic acid bacterium for the production of diacetyl and a food product.

15 Claims, 6 Drawing Sheets

Specification includes a Sequence Listing.

(56) References Cited

OTHER PUBLICATIONS

Guo et al; "Fine Tuning of the Lactate and Diacetyl Production through Promoter Engineering in Lactococcus lactis". Plos One, vol. 7, No. 4, E36296, Apr. 2012, pp. 1-10.
Henriksen et al; "Redirection of pyruvate catabolism in Lactococcus lactis by selection of mutants with additional growth requirements". Applied Microbiology and Biotechnology, vol. 56, No. 5-6, Sep. 1, 2001, pp. 767-776.
Liu et al; "Combining metabolic engineering and biocompatible chemistry for high-yield production of production of homo-diacetyl and homo-(S,S)-2,3-butanediol". Metabolic Engineering, Academic Press, US, vol. 36, Mar. 8, 2016, pp. 57-67.
Zhao et al; "Optimization and mechanism of diacetyl accumulation by Enterobacter aerogenes mutant UV-3". World Journal of Microbiology and Biotechnology, vol. 25, No. 1. Jan. 2009, pp. 57-64.
Anderson et et al.; "Simple and Rapid Method for Isolating Large Plasmid DNA from Lactic Streptococci"; Appl. Environ. Microbiol., vol. 46, No. 3, 549-552 (1983).
Barkholt et al.; Determination of Cysteine plus Half-Cycteine in Proteins after Hydrochloric Acid Hydrolysis with a Disulfide Compound as Additive; Analytical Biochemistry, 177, 318-322 (1989).
Benson et al.; Effect of ilvBN-encoded x-acetolactate synthase expression on diacetyl production in Lactococcus lactis; Appl. Microbiol Biotehcnol (1996) 45: 107-111.
Gasson, M.J.; "Plasmid Complements of *Streptococcus lactis* NCDO 712 and Other Lactic Streptococci after Protoplast-Induced Curing"; Journal of Bacteriology, vol. 154, No. 1, 1-9 (1983).
Goupil et al.; "Imbalance og Leucine Flux in Lactococcus lactis and Its Use for the Isolation of Diacetyl-Overproducing Strains"; Appl. Environ. Microbiol. 62, 2636-2640 (1996).
Han et al.; "Production of 2,3-butanediol by a low-acid producing Klebsiella oxytoca NBRF4"; New Biotechnology 30, 166-172 (2013).
Hayes et al.; "Identification of the Minimal Replicon of *Lactococcus lactis* subsp. lactis UC317 Plasmid pCI305"; Appl. Environ. Microbiol., vol. 56, No. 1, 202-209 (1990).
Holo et al.; "High-Frequency Transformation, by Electroporation, *Lactococcus lactis* subsp. cremoris Grown with Glycine in Osmotically Stabilized Media"; Appl. Environ. Microbiol. 55, No. 12, 1989: 3119-3123.
Maguin et al.; "Construction of food-grade mutants of lactic acid bacteria"; Le Lait, INRA Editions, 76 (1_2) 139-146 (1996).
Nørholm, M.H.H.; "A mutant Pfu DNA polymerase designed for advanced uracil-excision DNA engineering"; BMC Biotechnol. 10, 21 (2010).
Pearson et al.; "Improved tools fpor biological sequence comparison"; Proc. Natl. Acad. Sci. USA, vol. 85, 2444-2448 (1988).
Solem et al.; "Rewiring Lactococcus lactis for Ethanol Production"; Appl. Environ. Microbiol., vol. 79, No. 8, 2512-2518 (2013).
Solem et al.; Plasmid pCS1966, a New Selection/Counterselection Tool for Lactic Acid Bacterium Strain Construction Based on the oroP Gene Encoding an Orotate Transporter from Lactococcus lactis; Appl. Environ. Microbiol. 74, 4772-4775 (2008).
Terzaghi et al.; "Improved Medium for Lactic Streptococci and Their Bacteriophages"; Appl. Microbiol. 29, 807-813 (1975).
Thompson et al.; "Clustal W: improving the sensitivity of progressive ultiple sequence alignment through sequence weighting, position-specific gap penalties and weight matrix choice"; Nucleic Acid Research, vol. 22, No. 22, 4673-4680 (1994).
Wegmann et al.; "Smoking cessation with teenagers: The relationship between impulsivity, emotional problems, program retention and effectiveness"; Addictive Behaviors 37, 463-468 (2012).
Westerfeld, W.W.; "A colorimetric determination of paraldehyde"; J. Lab. Clin. Med. 30, 1076 (1945).
Zhang et al.; Mutation breeding of acetoin high producing BAcillus subtilis blocked in 2.3-butanedioil dehydrogenase; Worls J. Microbiol. Biotechnol., 29, 1783-1789 (2013).
Salminen et al., "Lactic acid bacteria: microbiological and functional aspects." Publisher: New York: Marcel Dekker, 2004; pp. 25-27.

* cited by examiner

Figure 6

| Gene | EC number | Function | Length (AA) |
|---|---|---|---|
| lacA | EC 5.3.1.26 | galactose-6-phosphate isomerase subunit | 141 |
| lacB | EC 5.3.1.26 | galactose-6-phosphate isomerase subunit | 171 |
| lacC | EC 2.7.1.144 | tagatose-6-phosphate kinase | 310 |
| lacD | EC 4.1.2.40 | tagatose-1,6-bisphosphate aldolase | 326 |
| lacE | EC 2.7.1.69 | PTS system, lactose-specific EIICB component | 568 |
| lacF | EC 2.7.1.69 | PTS system, lactose-specific EIIA component | 105 |
| lacG | EC 3.2.1.85 | phospho-β-D-galactosidase | 468 |
| lacX | EC 5.1.3.3 | aldose 1-epimerase | 299 |
| lacR | | lactose transport regulator | 255 |

HIGH-LEVEL PRODUCTION OF DIACETYL IN A METABOLICALLY ENGINEERED LACTIC ACID BACTERIUM

CROSS-REFERENCE TO RELATED APPLICATIONS

This application is a national phase application under 35 U.S.C. § 371 of PCT International Application No. PCT/EP2016/074043 filed Oct. 7, 2016, which claims priority to European Patent Application No. 16157443.9 filed Feb. 25, 2016, European Patent Application No. 15194710.8 filed Nov. 16, 2015, and European Patent Application No. 15189200.7 filed Oct. 9, 2015, each of which are hereby incorporated by reference in its entirety.

FIELD OF THE INVENTION

The present invention provides a genetically modified lactic acid bacterium capable of producing diacetyl under aerobic conditions. Additionally the invention provides a method for producing diacetyl using the genetically modified lactic acid bacterium under aerobic conditions in the presence of a source of iron-containing porphyrin and a metal ion selected from $Fe^{3+}$, $Fe^{2+}$ and $Cu^{2+}$. The lactic acid bacterium is genetically modified by deletion of those genes in its genome that encode polypeptides having lactate dehydrogenase (E.C 1.1.1.27/E.C.1.1.1.28); α-acetolactate decarboxylase (E.C 4.1.1.5); phosphotransacetylase (E.C.2.3.1.8), and water-forming NADH oxidase (E.C. 1.6.3.4) activity; and optionally is further devoid of genes or deleted for genes encoding polypeptides having diacetyl reductase ((R)-acetoin forming; EC:1.1.1.303); D-acetoin reductase; butanediol dehydrogenase ((R,R)-butane-2,3-diol forming; E.C. 1.1.1.4/1.1.1.-); and alcohol dehydrogenase (E.C. 1.2.1.10) activity. The invention provides for use of the genetically modified lactic acid bacterium for the production of diacetyl or a food product.

BACKGROUND OF THE INVENTION

Diacetyl is a high value flavor compound, which contributes to the buttery aroma of many fermented foods, including cheese, butter and butter milk. *Lactococcus lactis* has a native metabolic pathway leading to the synthesis of meso-2,3-butanediol. This pathway, starting from glycolysis employs two molecules of pyruvate which are condensed to α-acetolactate by the enzyme α-acetolactate synthase (ALS). Acetolactate, which is unstable, is converted to diacetyl by non-enzymatic oxidative decarboxylation. However, diacetyl accumulation is extremely low since most of the acetolactate flux is converted to acetoin by the activity of an α-acetolactate decarboxylase (ALDB), which in turn can be converted to meso-2,3-butanediol. The major fermentation products produced by *Lactococcus lactis* include lactate, ethanol and acetate.

In contrast to bacterial strains derived from pathogens, some lactic acid bacteria, in particular *Lactococcus* or *Lactobacillus* species are particularly suitable for production of food grade diacetyl, since they have "generally recognized as safe" (GRAS) status. In addition, they have a high glycolytic flux, and well-characterized metabolic pathways. Under normal conditions, *Lactococcus* or *Lactobacillus* species are fermentative and more than 90% of glucose is converted to lactate. Although diacetyl levels are very low in wild type lactic acid bacteria, the application of metabolic engineering strategies makes these bacteria suitable candidates for developing genetically modified strains capable of homo-diacetyl production. There exists a need for lactic acid bacteria having GRAS status that can produce diacetyl from glucose as substrate and where the conversion of glucose to diacetyl has a high mol/mol yield.

SUMMARY OF THE INVENTION

According to a first embodiment, the invention provides a genetically modified lactic acid bacterium for production of diacetyl, wherein the genome of said lactic acid bacterium is deleted for genes or lacks genes encoding polypeptides having an enzymatic activity of:
a) lactate dehydrogenase (E.C 1.1.1.27 or E.C.1.1.1.28)
b) α-acetolactate decarboxylase (E.C 4.1.1.5)
c) phosphotransacetylase (E.C.2.3.1.8)
d) NADH oxidase (E.C. 1.6.3.4); and
wherein said microorganism is devoid of transgenes encoding:
e) a polypeptide having diacetyl reductase (E.C.1.1.1.304) activity and
f) a polypeptide having L-butanediol dehydrogenase (E.C. 1.1.1.76) activity.

Preferably, the genome of the genetically modified lactic acid bacterium of the invention is additionally deleted for genes or lacks genes encoding polypeptides having an enzymatic activity of:
g) diacetyl reductase (E.C.1.1.1.303); h) D-acetoin reductase; i) butanediol dehydrogenase (E.C. 1.1.1.4) and j) alcohol dehydrogenase (E.C. 1.2.1.10).

Preferably, the genetically modified lactic acid bacterium of the invention belongs to a genus selected from the group consisting of *Lactococcus*, *Lactobacillus*, *Pediococcus*, *Leuconostoc*, *Streptococcus*, *Oenococcus*, and *Bacillus*.

According to a second embodiment, the invention provides a method for the production of diacetyl, comprising the steps of:
a. introducing a genetically modified lactic acid bacterium according to any embodiment of the invention into a growth medium to produce a culture, wherein the growth medium comprises a source of protoporphyrin IX or iron-containing porphyrin;
b. cultivating the culture of (a) under aerobic growth conditions;
c. recovering diacetyl produced by said culture, and optionally
d. isolating the recovered diacetyl.

Preferably, the source of iron-containing porphyrin is hemin or hematin in the growth medium, wherein the concentration of hemin or hematin is 0.3-5 μg/ml of the growth medium.

In a further embodiment of the method for the production of diacetyl, the combined total $Fe^{2+}$, $Fe^{3+}$ and $Cu^{2+}$ concentration of the growth medium in step (a) is less than 20 mM. Preferably, this method for the production of diacetyl includes an additional step of supplementing the culture produced in step (b) with one or more metal ion selected from the group consisting of $Fe^{2+}$, $Fe^{3+}$ and $Cu^{2+}$; and incubating the supplemented culture under aerobic conditions prior to step (c). Preferably, the step of supplementing the culture with metal ion increases the combined final concentration of $Fe^{3+}$ and $Cu^{2+}$; or $Fe^{2+}$, $Fe^{3+}$ and $Cu^{2+}$, in the medium to at least 5 mM.

According to a third embodiment, the invention provides for the use of a genetically modified lactic acid bacterium of the invention for production of diacetyl.

According to a fourth embodiment, the invention provides for the use of a genetically modified lactic acid bacterium of the invention for production of a food product; for example a milk product (e.g. fermented food product); as well as the food product comprising the genetically modified lactic acid bacterium.

DESCRIPTION OF THE INVENTION

(A) Cartoon showing the electron transport chain in *L. lactis*, from electron donor (NoxAB), electron transfer (menaquinone) to electron acceptor (Cyt bd oxidase), which is activated by hemin.

(B) Cell growth as measured by cell density ($OD_{600\ nm}$) as a function of time (hr) at a range of hemin concentrations rising from 0.2 µg/ml to 5.0 µg/ml.

(C) Cellular NAD+ levels and NADH/NAD+ ratio in *L. lactis* cultivate in at a range of hemin concentrations rising from 0.3 µg/ml to 5.0 µg/ml.

Experiments were carried out in duplicate and error bars indicate standard deviations.

Figure 3:
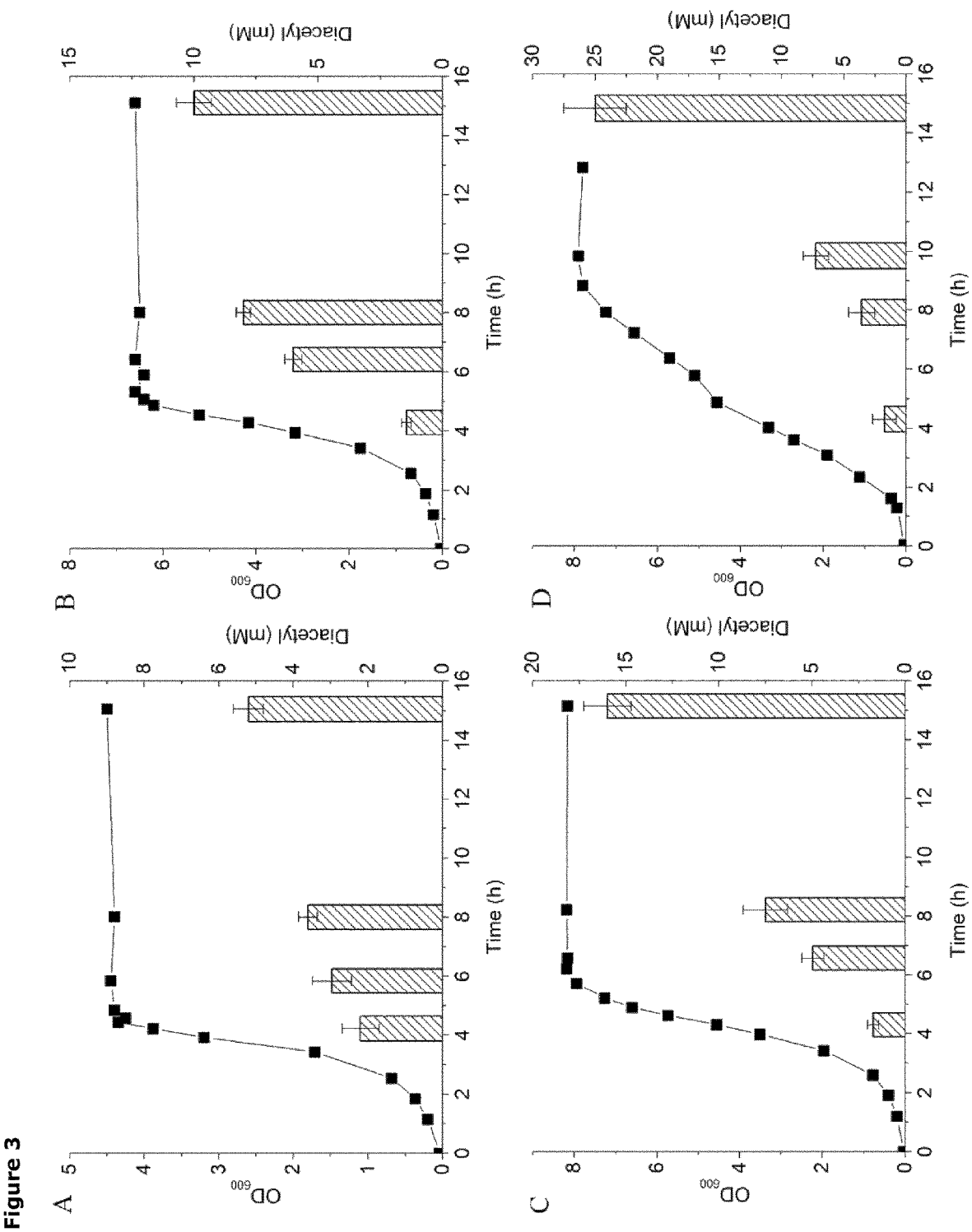

FIG. 3. Growth and diacetyl production of *L. Lactis* strain CS4616m at different initial glucose concentrations. Graphical presentation of cell growth, as measured by cell density ($OD_{600\ nm}$), and diacetyl concentrations in mM (bar) as a function of time (hr) of *L. Lactis* strain CS4616m. (A) 25 mM glucose; (B) 50 mM glucose; (C) 75 mM glucose; (D) 108 mM glucose.

Figure 4:
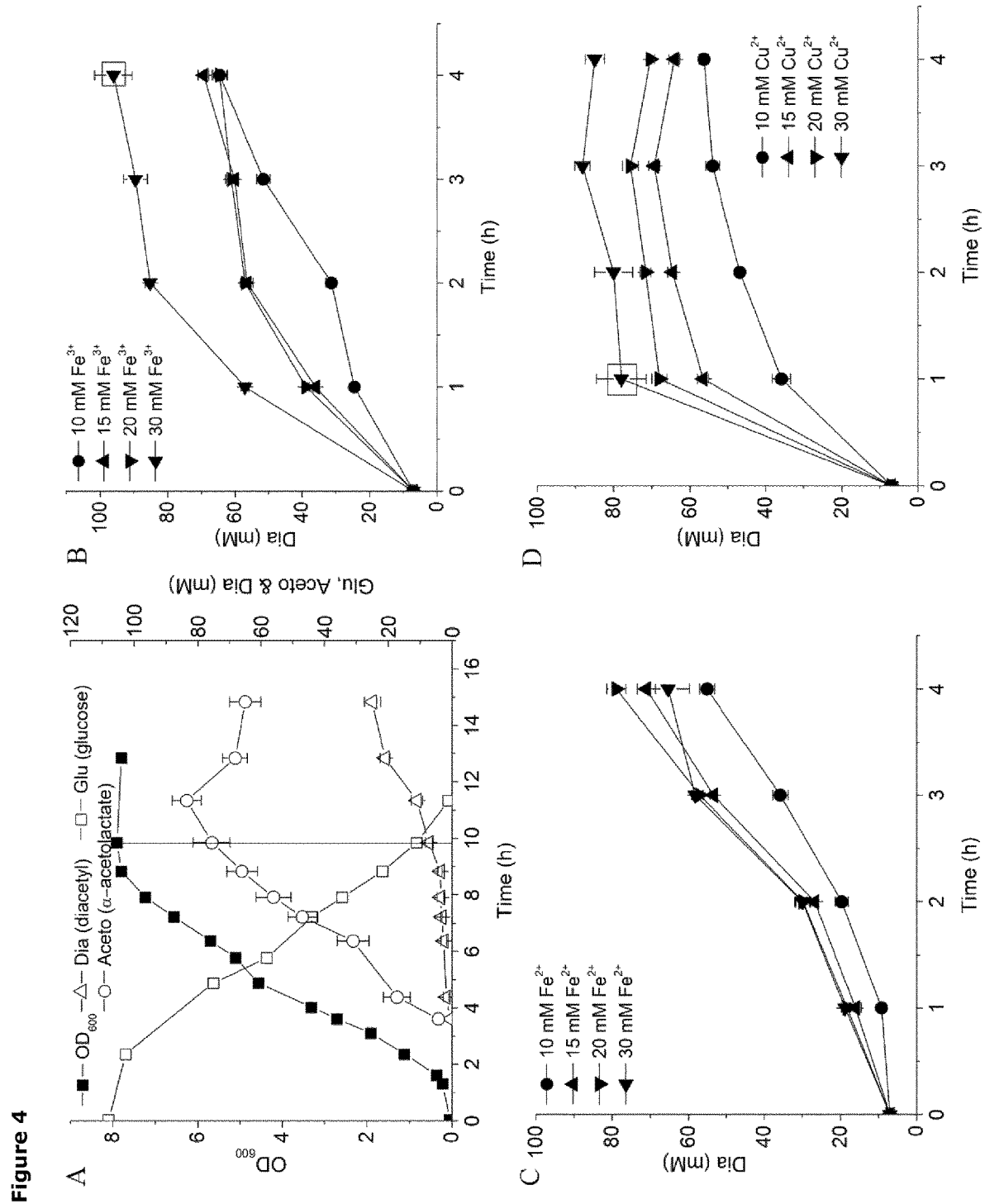

FIG. 4. Enhanced diacetyl production of *L. Lactis* strain CS4616m. Graphical representation of cell growth, as measured by cell density at $OD_{600\ nm}$, and product formation (bar), in mM, as a function of time (hr), for *L. Lactis* strain CS4616m growing on 108 mM glucose (A).

Graphical presentation of diacetyl formation from acetolactate as a function of time (hr) when *L. lactis* strain CS4616m is cultured in the presence of increasing levels of either $Fe^{3+}$ (B); $Fe^{2+}$ (C); and $Cu^{2+}$ (D). The time point for adding the metal catalysts during the cultivation of *L. Lactis* strain CS4616m was at 9.8 h, which is indicated by the straight line in (A). Experiments were conducted in duplicate and error bars indicate standard deviations.

Figure 5:
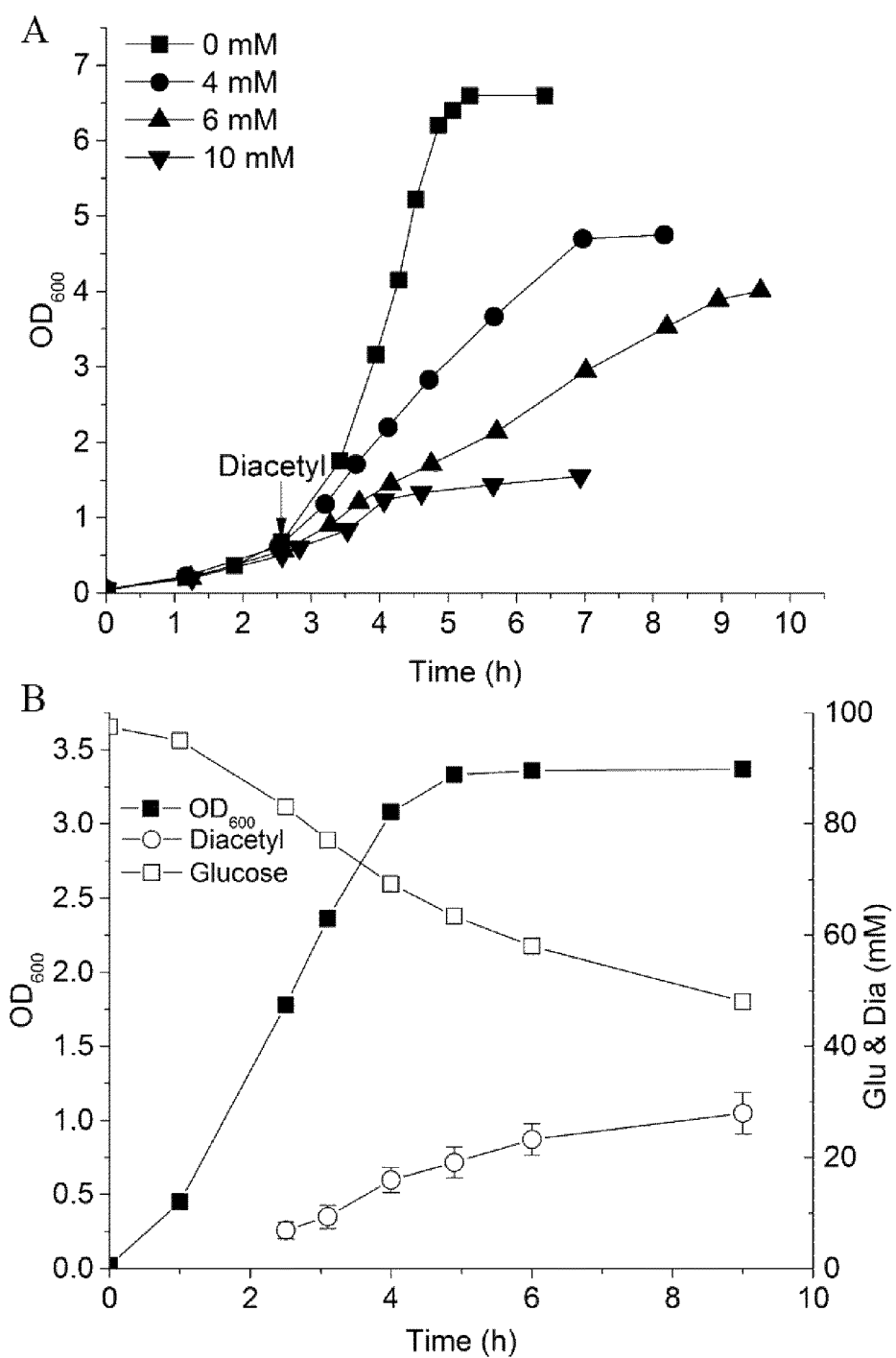

FIG. 5. Inhibitory effect of diacetyl on growth of *L. lactis* CS4616m. (A) Graphical presentation of cell growth of *L. Lactis* strain CS4616m, as measured by cell density ($OD_{600\ nm}$), in the presence of diacetyl (0-10 mM), which was added when the culture reached a cell density ($OD_{600\ nm}$) of 0.6. (B) Graphical presentation of cell growth of *L. Lactis* strain CS4616m, as measured by cell density ($OD_{600\ nm}$), and substrate/product profile in the presence of 10 mM $Fe^{3+}$ (added in the beginning of growth phase).

FIG. 6. Cartoon showing the genes contained in the lactose operon, which is present on the pLP712 plasmid derived from industrial dairy starter strain NCDO712. The plasmid confers on a cell the ability to take up lactose via a lactose-specific phosphotransferase system (PTS), encoded by lacEF genes, whereafter phosphorylated lactose is hydrolyzed to glucose and galactose-6-phosphate (gal-6-P) by the phospho-β-galactosidase (lacG gene). The glucose moiety enters into glycolysis, while gal-6-P is degraded via the tagatose-6-P pathway (lacABCD genes).

ABBREVIATIONS AND TERMS gi number: (genInfo identifier) is a unique integer which identifies a particular sequence, independent of the database source, which is assigned by NCBI to all sequences processed into Entrez, including nucleotide sequences from DDBJ/EMBL/GenBank, protein sequences from SWISS-PROT, PIR and many others.

Amino acid sequence identity: The term "sequence identity" as used herein, indicates a quantitative measure of the degree of homology between two amino acid sequences of substantially equal length. The two sequences to be compared must be aligned to give a best possible fit, by means of the insertion of gaps or alternatively, truncation at the ends of the protein sequences. The sequence identity can be calculated as ((Nref-Ndif)100)/(Nref), wherein Ndif is the total number of non-identical residues in the two sequences when aligned and wherein Nref is the number of residues in one of the sequences. Sequence identity can alternatively be calculated by the BLAST program e.g. the BLASTP program (Pearson W.R and D.J. Lipman (1988)) (www.ncbi.nlm.nih.gov/cgi-bin/BLAST). In one embodiment of the invention, alignment is performed with the sequence alignment method ClustalW with default parameters as described by Thompson J., et al 1994.

Preferably, the numbers of substitutions, insertions, additions or deletions of one or more amino acid residues in the polypeptide as compared to its comparator polypeptide is limited, i.e. no more than 1, 2, 3, 4, 5, 6, 7, 8, 9, or 10 substitutions, no more than 1, 2, 3, 4, 5, 6, 7, 8, 9, or 10 insertions, no more than 1, 2, 3, 4, 5, 6, 7, 8, 9, or 10 additions, and no more than 1, 2, 3, 4, 5, 6, 7, 8, 9, or 10 deletions. Preferably the substitutions are conservative amino acid substitutions: limited to exchanges within members of group 1: Glycine, Alanine, Valine, Leucine, Isoleucine; group 2: Serine, Cysteine, Selenocysteine, Threonine, Methionine; group 3: Proline; group 4: Phenylalanine, Tyrosine, Tryptophan; Group 5: Aspartate, Glutamate, Asparagine, Glutamine.

Deleted gene: the deletion of a gene from the genome of a microbial cell leads to a loss of function (knockout) of the gene and hence where the gene encodes a polypeptide the deletion results in a loss of expression of the encoded polypeptide. Where the encoded polypeptide is an enzyme, the gene deletion leads to a loss of detectable enzymatic activity of the respective polypeptide in the microbial cell. A deleted gene in the genome of a microbial cell is characterized by a loss of function due to the deletion of, or substitution of, or addition of, at least one nucleotide leading to a loss of expression of a polypeptide encoded by the gene.

Diacetyl reductase (E.C. 1.1.1.304) has (S)-acetoin forming activity, and is capable of converting diacetyl (DA) to L-acetoin (L-AC)

L-butanediol dehydrogenase (E.C. 1.1.1.76) is capable of converting L-acetoin (L-AC) to S,S-2,3-butanediol (L-BD).

Native gene: endogenous gene in a microbial cell genome, homologous to host micro-organism.

Transgenes encoding polypeptides having diacetyl reductase activity (E.C. 1.1.1.304) and L-butanediol dehydrogenase activity (E.C.1.1.1.76) confer on a cell the ability to convert diacetyl (L-AC) to S,S-2,3-butanediol (L-BD).

Whey and whey permeate and residual whey permeate: whey is a byproduct of cheese manufacture; and comprises whey proteins having a high nutritional value and lactose. Removal of whey proteins, typically by means of ultrafiltration or diafiltration produces a whey protein concentrate and whey permeate that is lactose-rich. The lactose content of the whey permeate is dependent on the treatment conditions and typically it can reach as high as hundreds of grams per liter by reverse osmosis, such as 200 g/L. Removal of fat from whey, or from lactose-rich permeate, typically by centrifugation, yields a fat-free composition (whey or permeate). Residual whey permeate (also called permeate mother liquor) is obtained after the extraction of lactose from whey permeate (typically by lactose crystallisation); and has a lower lactose content of about 150 g/L.

DETAILED DESCRIPTION OF THE INVENTION

I: A Genetically Modified Lactic Acid Bacterium for the Production of Diacetyl

Endogenous Genes Deleted to Enhance Metabolic Flux from Pyruvate to Diacetyl

The lactic acid bacterium of the invention is adapted to produce diacetyl from glucose under aerobic conditions. The lactic acid bacterium of the invention is characterised by an enhanced metabolic flux from pyruvate to diacetyl, due to reduced activity in the enzymes in the pathways leading to the synthesis of lactate, acetate and ethanol. The production of acetate and ethanol by a lactic acid bacterium is reduced when the bacterium is cultivated under aerobic conditions, in a defined growth medium lacking lipoic acid. When the bacterium is cultivated under aerobic conditions, this inactivates the enzyme pyruvate formate lyase that forms formate and acetyl-CoA, which are the precursors of the acetate and ethanol pathways. Since the enzyme, pyruvate dehydrogenase, requires lipoic acid for activity, the use of a lipoic acid-deficient growth medium (supplemented with acetate) inactivates the synthesis of acetyl-CoA by pyruvate dehydrogenase and the down-stream production of acetate and ethanol. When the lactic acid bacterium of the invention is grown under anaerobic conditions in a minimal medium deficient in lipoic acid, the requirement for acetyl-CoA is met by adding acetate to the growth medium.

In one embodiment, the metabolic flux towards lactate, acetate and ethanol in the lactic acid bacterium of the invention is reduced by deletion of one or more genes encoding enzymes of both the lactate, acetate and optionally ethanol pathways.

Ii Deletion of an endogenous lactate synthesis pathway: The lactic acid bacterium of the invention is characterised by knockouts of one or more endogenous native genes encoding polypeptides having lactate dehydrogenase activity causing a block in the lactate synthesis pathway in the bacterium. Deletion of at least one gene (e.g. ldh) encoding a lactate dehydrogenase enzyme (E.C 1.1.1.27 or E.C.1.1.1.28) provides a lactic acid bacterium of the invention that is depleted in lactate production. For example, where the lactic acid bacterium of the invention belongs to a given genus, the deleted endogenous gene is one encoding a polypeptide having lactate dehydrogenase activity in that genus. Preferably the polypeptide having lactate dehydrogenase activity (E.C 1.1.1.27 or E.C.1.1.1.28) has at least 70, 72, 74, 76, 78, 80, 82, 84, 86, 88, 90, 92, 94, 96, 98, 99 or 100% amino acid sequence identity to one of the following sequences: SEQ ID NO: 2 in a *Lactococcus* species (e.g. *Lactococcus lactis*); SEQ ID NO: 4, 6, or 8 in a *Lactobacillus* species (e.g. *Lactobacillus acidophilus*); SEQ ID NO: 10 in a *Lactobacillus* species (e.g. *Lactobacillus delbrueckii*); SEQ ID NO. 12, 14 or 16 in a *Lactobacillus* species (e.g. *Lactobacillus casei*), SEQ ID NO. 18 or 20 in a *Lactobacillus* species (e.g. *Lactobacillus plantarum*); SEQ ID NO: 22 in a *Pediococcus* species (e.g. *Pediococcus pentosaceus*), SEQ ID NO: 24 or 26 in a *Leuconostoc* species (e.g. *Leuconostoc mesenteroides*), SEQ ID NO: 28 in a *Streptococcus* species (e.g. *Streptococcus thermophilus*), SEQ ID NO: 30 or 32 in a *Oenococcus* species (e.g. *Oenococcus oeni*), and SEQ ID NO: 34 or 36 in a *Bacillus* species (e.g. *Bacillus coagulans*).

In one embodiment, an additional endogenous gene, encoding a polypeptide having lactate dehydrogenase enzymatic activity (E.C 1.1.1.27 or E.C.1.1.1.28), is deleted from the lactic acid bacterium of the invention. For example, where the lactic acid bacterium of the invention belongs to the genus *Lactococcus*, the deleted gene (ldhX) encodes a polypeptide having at least 70, 72, 74, 76, 78, 80, 82, 84, 86, 88, 90, 92, 94, 96, 98, 99 or 100% amino acid sequence identity to SEQ ID NO: 38.

In one embodiment, an additional endogenous gene, encoding a polypeptide having lactate dehydrogenase enzymatic activity (E.C 1.1.1.27 or E.C.1.1.1.28), is deleted from the lactic acid bacterium of the invention. For example, where the lactic acid bacterium of the invention belongs to the genus *Lactococcus*, the deleted gene (ldhB) encodes a polypeptide having at least 70, 72, 74, 76, 78, 80, 82, 84, 86, 88, 90, 92, 94, 96, 98, 99 or 100% amino acid sequence identity to SEQ ID NO: 40. Further, where the lactic acid bacterium of the invention belongs to the genus *Lactococcus*, the three genes (ldh, ldhB and ldhX) encoding a polypeptide having at least 70% amino acid sequence identity to SEQ ID NO: 2, 38 and 40 respectively may be deleted.

Iii Deletion of an endogenous acetate synthesis pathway: In one embodiment, the lactic acid bacterium of the invention is characterised by knockout of the endogenous native gene encoding a phosphotransacetylase (E.C.2.3.1.8), causing a block in the acetate synthesis pathway in the bacterium. Deletion of a gene (e.g. pta) encoding a phosphotransacetylase enzyme provides a lactic acid bacterium of the invention that is blocked in acetate production. For example, where the lactic acid bacterium of the invention belongs to a given genus, the deleted endogenous gene is one encoding a polypeptide having phosphotransacetylase activity (E.C.2.3.1.8) in that genus. Preferably the polypeptide having phosphotransacetylase activity has at least 70, 72, 74, 76, 78, 80, 82, 84, 86, 88, 90, 92, 94, 96, 98, 99 or 100% amino acid sequence identity to one of the following sequences: SEQ ID NO: 42 in a *Lactococcus* species (e.g. *Lactococcus lactis*); SEQ ID NO: 44, 46, 48, and 50 in a *Lactobacillus* species (e.g. *Lactobacillus acidophilus, Lactobacillus delbrueckii, Lactobacillus casei, Lactobacillus plantarum*), SEQ ID NO: 52 in a *Pediococcus* species (e.g. *Pediococcus pentosaceus*), SEQ ID NO: 54 in a *Leuconostoc* species (e.g. *Leuconostoc mesenteroides*), SEQ ID NO: 56 in a *Streptococcus* species (e.g. *Streptococcus thermophilus*), SEQ ID NO: 58 *Oenococcus* species (e.g. *Oenococcus oeni*), and SEQ ID NO: 60 in a *Bacillus* species (e.g. *Bacillus coagulans*).

Iiii Deletion of an endogenous ethanol synthesis pathway: In one embodiment, the lactic acid bacterium of the invention is characterised by knockout of the endogenous native gene encoding alcohol dehydrogenase (E.C.1.2.1.10) causing a block in the ethanol synthesis pathway in the bacterium. Deletion of the gene encoding an alcohol dehydrogenase enzyme provides a lactic acid bacterium of the invention that is blocked in ethanol production.

For example, where the lactic acid bacterium of the invention belongs to a given genus, the deleted endogenous gene (e.g. adhE) is one encoding a polypeptide having alcohol dehydrogenase activity (E.C.1.2.1.10) in that genus. Preferably the polypeptide having alcohol dehydrogenase activity has at least 70, 72, 74, 76, 78, 80, 82, 84, 86, 88, 90, 92, 94, 96, 98, 99 or 100% amino acid sequence identity to one of the following sequences: SEQ ID NO: 62 in a *Lactococcus* species (e.g. *Lactococcus lactis*); SEQ ID NO: 64 in a *Lactobacillus* species (e.g. *Lactobacillus acidophilus*); SEQ ID NO: 66 or 68 in a *Lactobacillus* species (e.g. *Lactobacillus casei*); SEQ ID NO: 70 in a *Lactobacillus* species (e.g., *Lactobacillus plantarum*), SEQ ID NO: 72 in a *Leuconostoc* species (e.g. *Leuconostoc mesenteroides*), SEQ ID NO: 74 in a *Streptococcus* species (e.g. *Streptococcus thermophilus*), SEQ ID NO: 76 in a *Oenococcus* species (e.g. *Oenococcus oeni*), and SEQ ID NO: 78 in a *Bacillus* species (e.g. *Bacillus coagulans*).

Endogenous Genes Deleted to Enhance Diacetyl Accumulation

Iiv Deletion of an Endogenous 2,3-butanediol Synthesis Pathway

The lactic acid bacterium of the invention may be characterized by additional knockouts of the endogenous native genes encoding enzymes having α-acetolactate decarboxylase (E.C 4.1.1.5), a diacetyl reductase (EC:1.1.1.303); D-acetoin reductase, and a 2,3-butanediol dehydrogenase ((R,R)-butane-2,3-diol forming; E.C 1.1.1.4/1.1.1.-) activity, thereby causing a block in the 2,3-butanediol synthesis pathway in the bacterium for conversion of α-acetolactate, via D-acetoin or diacetyl, to 2,3-butanediol. When the lactic acid bacterium of the invention is devoid of these endogenous native genes encoding the native 2,3-butanediol pathway; and is also devoid of transgenes encoding a diacetyl reductase (E.C.1.1.1.304) and a L-butanediol dehydrogenase (E.C. 1.1.1.76), the cells are unable to produce meso 2,3-butanediol or its chiral forms.

In the case where the lactic acid bacterium of the invention belongs to a given genus, that lacks one or more endogenous native gene encoding one or more polypeptide having α-acetolactate decarboxylase activity (E.C 4.1.1.5), diacetyl reductase (EC:1.1.1.303); D-acetoin reductase, 2,3-butanediol dehydrogenase (E.C 1.1.1.4/1.1.1.-) activity or any combination thereof; the step of deletion of the respective gene in order to produce the bacterium of the invention is not required. Accordingly the lactic acid bacterium of the invention lacking endogenous native genes that express enzymes having α-acetolactate decarboxylase (E.C 4.1.1.5), diacetyl reductase (EC.1.1.1.303); D-acetoin reductase, and a 2,3-butanediol dehydrogenase ((R,R)-butane-2,3-diol forming; E.C 1.1.1.4/1.1.1.-) activity, may be due either to the absence of genes encoding and expressing said enzymes in the lactic acid bacterium of the invention, or due to deletion of the respective gene from the genome of the bacterium.

Deletion of an endogenous native gene (e.g. aldB) encoding an α-acetolactate decarboxylase enzyme (E.C 4.1.1.5) provides a lactic acid bacterium of the invention that is blocked in D-acetoin production. For example, where the lactic acid bacterium of the invention belongs to a given genus, the deleted endogenous gene is one encoding a polypeptide having α-acetolactate decarboxylase activity (E.C 4.1.1.5) in that genus. Preferably the polypeptide having α-acetolactate decarboxylase activity has at least 70, 72, 74, 76, 78, 80, 82, 84, 86, 88, 90, 92, 94, 96, 98, 99 or 100% amino acid sequence identity to one of the following sequences: SEQ ID NO: 80 in a *Lactococcus* species (e.g. *Lactococcus lactis*); SEQ ID NO: 82, or 84 in a *Lactobacillus* species (e.g. *Lactobacillus casei, Lactobacillus plantarum*), SEQ ID NO: 86 in a *Pediococcus* species (e.g. *Pediococcus pentosaceus*), SEQ ID NO: 88 or 90 *Leuconostoc* species (e.g. *Leuconostoc mesenteroides*), SEQ ID NO: 92 in a *Streptococcus* species (e.g. *Streptococcus thermophilus*), SEQ ID NO: 94 in a *Oenococcus* species (e.g. *Oenococcus oeni*), and SEQ ID NO: 96 in a *Bacillus* species (e.g. *Bacillus coagulans*).

Deletion of an endogenous native gene (e.g. dar) encoding diacetyl reductase (EC:1.1.1.303) provides a lactic acid bacterium of the invention that is blocked in D-acetoin production. For example, where the lactic acid bacterium of the invention belongs to the genus *Lactococcus* (e.g. *Lactococcus lactis*), the deleted gene (dar) encodes a polypeptide having at least 70, 72, 74, 76, 78, 80, 82, 84, 86, 88, 90, 92, 94, 96, 98, 99 or 100% amino acid sequence identity to SEQ ID NO: 98.

Deletion of an endogenous native gene (e.g. ar) encoding a D-acetoin reductase enzyme provides a lactic acid bacterium of the invention that is blocked in D-acetoin production. For example, where the lactic acid bacterium of the invention belongs to a given genus, the deleted endogenous gene is one encoding a polypeptide having D-acetoin reductase activity in that genus. Preferably the polypeptide having D-acetoin reductase activity has at least 70, 72, 74, 76, 78, 80, 82, 84, 86, 88, 90, 92, 94, 96, 98, 99 or 100% amino acid sequence identity to one of the following sequences: SEQ ID NO: 100 in a *Lactococcus* species (e.g. *Lactococcus lactis*); SEQ ID NO: 102 in a *Pediococcus* species (e.g. *Pediococcus pentosaceus*), SEQ ID NO: 104 or 106 in a *Leuconostoc* species (e.g. *Leuconostoc mesenteroides*), SEQ ID NO: 108 or 110 *Oenococcus* species (e.g. *Oenococcus oeni*), SEQ ID NO: 112 in a *Bacillus* species (e.g. *Bacillus coagulans*), SEQ ID NO: 198 or 200 in a *Lactobacillus* species (e.g. *Lactobacillus buchneri*).

Deletion of a gene (e.g. butAB) encoding 2, 3-butanediol dehydrogenase activity (E.C 1.1.1.4/1.1.1.-) provides a lactic acid bacterium of the invention that is blocked in meso-2,3-butanediol production. For example, where the lactic acid bacterium of the invention belongs to the genus *Lactococcus* (e.g. *Lactococcus lactis*), the deleted gene (butAB) encodes a polypeptide having at least 70, 72, 74, 76, 78, 80, 82, 84, 86, 88, 90, 92, 94, 96, 98, 99 or 100% amino acid sequence identity to SEQ ID NO: 114.

Endogenous Genes Deleted to Maintain a Balance of Redox Equivalents

Iv Deletion of an Endogenous NADH Oxidation Activity

The lactic acid bacterium of the invention is characterized by knockout of the endogenous native gene(s) encoding a water-forming NADH oxidase causing a block in NADH oxidation, and maintenance of reduced NADH levels. Deletion of a gene (e.g. noxE) provides a lactic acid bacterium of the invention that is partially blocked in NADH oxidation.

For example, where the lactic acid bacterium of the invention belongs to a given genus, the deleted endogenous gene is one encoding a polypeptide having water-forming NADH oxidase activity (E.C. 1.6.3.4) in that genus. Preferably the polypeptide having NADH oxidase activity has at least 70, 72, 74, 76, 78, 80, 82, 84, 86, 88, 90, 92, 94, 96, 98, 99 or 100% amino acid sequence identity to one of the following sequences: SEQ ID NO: 116 in a *Lactococcus* species (e.g. *Lactococcus lactis*); SEQ ID NO: 118 in *Lactobacillus casei*), SEQ ID NO: 120, 122, 124, 126 and 128 in *Lactobacillus plantarum*, SEQ ID NO: 130 in a *Streptococcus* species (e.g. *Streptococcus thermophilus*), SEQ ID NO: 132, 134 and 136 in a *Bacillus* species (e.g. *Bacillus coagulans*).

In the case that the lactic acid bacterium of the invention belongs to a given genus, that lacks an endogenous native gene encoding one or more polypeptide having water-forming NADH oxidase activity (E.C. 1.6.3.4) activity; the step of deletion of the respective gene in order to produce the bacterium of the invention is not required. Accordingly the lactic acid bacterium of the invention lacks endogenous native genes that express an enzyme having water-forming NADH oxidase activity (E.C. 1.6.3.4) activity, either due to the absence of gene encoding said enzyme in the lactic acid bacterium of the invention, or due to deletion of the respective gene from the genome of the bacterium.

The genetically modified lactic acid bacterium of the invention is characterised by the ability to produce diacetyl from a carbon source (e.g. glucose) in surprisingly high amounts (Example 3: product level of 95 mM diacetyl) in very high yields (Example 3: diacetyl yield: 0.87 mol mol−1 glucose) and very high productivity (Example 3: diacetyl produced: 0.58 g/L·h).

I.vi Genes Encoding Enzymes of the Lactose Catabolism Pathway:

The lactic acid bacterium of the invention may further comprise the following native genes or transgenes required for lactose assimilation and catabolism:

1) a first and second gene encoding a first and a second polypeptide component together conferring lactose-specific phosphotransferase system (PTS) activity (EC 2.7.1.69), whereby phosphorylated lactose is assimilated by the cells. The amino acid sequence of the first polypeptide component has at least 70, 72, 74, 76, 78, 80, 82, 84, 86, 88, 90, 92, 94, 96, 98, 99 or 100% sequence identity to the amino acid sequence of the phosphotransferase system EIICB component (SEQ ID NO: 210) encoded by the *Lactococcus lactis* lacE gene; and the amino acid sequence of the second polypeptide component has at least 70, 72, 74, 76, 78, 80, 82, 84, 86, 88, 90, 92, 94, 96, 98, 99 or 100% sequence identity to the amino acid sequence of the phosphotransferase system EIIA component (SEQ ID NO: 212) encoded by the *Lactococcus lactis* lacF gene; and 2) a gene encoding a polypeptide having phospho-β-D-galactosidase activity (EC 3.2.1.85) that hydrolyzes lactose-6-phosphate to glucose and galactose-6-phosphate (gal-6-P), whereby the glucose moiety can then enter the glycolytic pathway. The amino acid sequence of the polypeptide has at least 70, 72, 74, 76, 78, 80, 82, 84, 86, 88, 90, 92, 94, 96, 98, 99 or 100% sequence identity to the amino acid sequence of the phospho-β-D-galactosidase (SEQ ID NO: 214) encoded by the *Lactococcus lactis* lacG gene.

Additionally, the following genes encoding enzymes in the tagatose-6-P pathway, whereby gal-6-P is degraded and enters the glycolytic pathway as glyceraldehyde-3-phosphate, are required:

3) a first and second gene encoding a first and a second polypeptide subunit together conferring galactose-6-phosphate isomerase activity (EC 5.3.1.26). The amino acid sequence of the first polypeptide subunit has at least 70, 72, 74, 76, 78, 80, 82, 84, 86, 88, 90, 92, 94, 96, 98, 99 or 100% sequence identity to the amino acid sequence of the first subunit of the galactose-6-phosphate isomerase (SEQ ID NO: 202) encoded by the *Lactococcus lactis* lacA gene; and the amino acid sequence of the second polypeptide subunit has at least 70, 72, 74, 76, 78, 80, 82, 84, 86, 88, 90, 92, 94, 96, 98, 99 or 100% sequence identity to the amino acid sequence of the second subunit of the galactose-6-phosphate isomerase (SEQ ID NO: 204) encoded by the *Lactococcus lactis* lacB gene; and 4) a gene encoding a polypeptide having D-tagatose-6-phosphate kinase activity (EC 2.7.1.114). The amino acid sequence of the polypeptide has at least 70, 72, 74, 76, 78, 80, 82, 84, 86, 88, 90, 92, 94, 96, 98, 99 or 100% sequence identity to the amino acid sequence of the D-tagatose-6-phosphate kinase (SEQ ID NO: 206) encoded by the *Lactococcus lactis* lacC gene; and 5) a gene encoding a polypeptide having tagatose 1,6-diphosphate aldolase activity (EC 4.1.2.40). The amino acid sequence of the polypeptide has at least 70, 72, 74, 76, 78, 80, 82, 84, 86, 88, 90, 92, 94, 96, 98, 99 or 100% sequence identity to the amino acid sequence of the tagatose 1,6-diphosphate aldolase (SEQ ID NO: 208) encoded by the *Lactococcus lactis* lacD gene; and 6) optionally a gene encoding a polypeptide having lactose transport regulator activity. The amino acid sequence of the polypeptide has at least 70, 72, 74, 76, 78, 80, 82, 84, 86, 88, 90, 92, 94, 96, 98, 99 or 100% sequence identity to the amino acid sequence of the lactose transport regulator (SEQ ID NO: 216) encoded by the *Lactococcus lactis* lacR gene.

A genetically modified lactic acid bacterium according to the invention, comprising genes encoding and capable of expressing a functional lactose pathway, are able to use lactose as sole carbon source for the production of diacetyl. When whey permeate or residual whey permeate is used as a source of lactose and is a component of the growth medium; then the medium should be supplemented with a source of complex amino nitrogen (comprising soluble proteins and/or peptides; peptides and/or amino acids). Yeast extract is a suitable source of complex amino nitrogen; as well as CSL provided that it is provided in a hydrolysed form as described herein.

II A Genetically Modified Lactic Acid Bacterium Comprising a Pathway for Diacetyl Production The genetically modified lactic acid bacterium according to the invention, comprising a pathway for synthesis of diacetyl, is a member of a genus of lactic acid bacteria selected from the group consisting of *Lactococcus*, *Lactobacillus*, *Pediococcus*, *Leuconostoc*, *Streptococcus*, *Oenococcus*, and *Bacillus*. The lactic acid bacterium of the invention may for example be a species of lactic acid bacteria selected from the group consisting of *Lactococcus lactis*, *Lactobacillus acidophilus*, *Lactobacillus delbrueckii*, *Lactobacillus casei*, *Lactobacillus plantarum*, *Pediococcus pentosaceus*, *Leuconostoc mesenteroides*, *Streptococcus thermophilus*, *Oenococcus oeni* and *Bacillus coagulans*. Preferably the lactic acid bacterium of the invention is a species of *Lactococcus*.

III Methods for Producing Diacetyl Using the Genetically Modified Micro-Organism of the Invention Diacetyl can be produced using a lactic acid bacterium of the invention by introducing the bacterium into a culture medium comprising a carbon source for diacetyl biosynthesis; providing the culture with a source of protoporphyrin IX or iron-containing porphyrin (e.g. hemin and hematin) and culturing the bacterium under aerobic conditions (for example: to allow for bacterial cell growth and multiplication to reach a desired biomass); and then adding one or more metal ion selected from the group of $Fe^{2+}$, $Fe^{3+}$ and $Cu^{2+}$ to the culture and incubating the culture further under aerobic culture conditions; and finally recovering the diacetyl produced by the culture, as illustrated in the Examples.

During the cultivation step, cells of the lactic acid bacterium of the invention grow and multiply, where a supply of an iron-containing porphyrin, in limited amounts, is essential for growth of the cells under aerobic conditions. In a preferred embodiment, the protoporphyrin IX or iron-containing porphyrin is provided to the culture, by addition to the culture medium either prior to and subsequent to the introduction of the lactic acid bacterium into the culture medium. The protoporphyrin IX or iron-containing porphyrin may be added continuously or as a batch addition to the culture during growth of the culture. For example hemin is preferably added in amounts to provide a final concentration in the liquid culture medium of 0.1-5 µg/ml. Surprisingly, even though the cells are grown under aerobic conditions during this cultivation step, the major fermentation product produced by the cells is α-acetolactate, while the accumulation of diacetyl is limited. Further it has surprisingly been observed, that the growth and multiplication of the cells during the cultivation step is not inhibited by the accumulation of α-acetolactate in the cells and culture medium. The method of producing diacetyl using cells of the lactic acid bacterium of the invention, takes advantage of the α-acetolactate tolerance of the growing cells; since the levels of α-acetolactate (the direct precursor for diacetyl) can accumulate during this cultivation step without compromising growth or eventual diacetyl production. Since diacetyl itself, is shown to inhibit cell growth (see Example 3.2), which in turn would limit α-acetolactate production, the method of the invention employs growth conditions during the cultivation step that support cell growth and α-acetolactate production, but limit the chemical oxidation of α-acetolactate to diacetyl. For the reasons set forth below, the concentration of the following metal ions in the growth medium, provided during the cultivation step, is preferably ≤10 mM $Fe^{2+}$ (e.g. ≤1 mM $Fe^{2+}$; ≤0.1 mM $Fe^{2+}$); ≤10 mM $Fe^{3+}$ (e.g. ≤5 mM $Fe^{3+}$; ≤1 mM $Fe^{3+}$; ≤0.1 mM $Fe^{3+}$; ≤0.01 mM $Fe^{3+}$;) and ≤1 mM $Cu^{2+}$ (e.g. ≤0.1 mM $Cu^{2+}$; ≤0.01 mM $Cu^{2+}$, ≤0.001 mM $Cu^{2+}$). A typical growth medium used for cultivation of lactic acid bacterium of the invention comprises one or more of the following metal ions in a concentration range of 0.005-10 mM $Fe^{2+}$, 0.005-10 mM $Fe^{3+}$ and 0-1 mM $Cu^{2+}$; corresponding to a total combined concentration of $Fe^{2+}$, $Fe^{3+}$ and $Cu^{2+}$ in the range of 0.005-20 mM.

The lactic acid bacterium of the invention will grow and produce α-acetolactate (and diacetyl in limited amounts), when supplied with a suitable carbon source including glucose, maltose, galactose, fructose, sucrose, arabinose, xylose, raffinose, mannose, and lactose.

When the lactic acid bacterium of the invention is a strain of *Lactococcus lactic*, the preferred temperature for cultivation is 30° C.; while the selection of a suitable temperature for growth of lactic acid bacteria of the invention belonging to other Genus lies within the competence of the skilled man.

Following the cultivation step, (where the cells of the lactic acid bacterium of the invention have been cultivated to reach a desired biomass), the cells are then further incubated. In this incubation step, the α-acetolactate produced by the cells and released into the growth medium, is slowly converted to diacetyl by chemical oxidation. The method of diacetyl production may thus include an incubation step prior to recovery of the diacetyl. Surprisingly, it has been observed that the rate of chemical oxidation of the α-acetolactate (produced by the cells) to diacetyl can be enhanced during this incubation step, by the addition of metal ions, in the form of $Fe^{2+}$, $Fe^{3+}$ and $Cu^{2+}$. Accordingly, in one embodiment one or more of the combined final concentration of these one or more metal ions is 5 mM. Preferably the metal ions is $Fe^{3+}$ and/or $Cu^{2+}$ in a combined final concentration of at least 6 mM, 8 mM, 10 mM, 12 mM, 14 mM, 16 mM, 18 mM, 20 mM, 22 mM, 24 mM, 26 mM, 28 mM and 30 mM; more preferably between 15 mM and 30 mM.

Diacetyl produced by the lactic acid bacterium of the invention, can be recovered from the growth medium; and where the diacetyl is an intracellular product, it can be recovered from cells of the micro-organism of the invention by permeabilization of cell membranes combined with extraction of the diacetyl, employing standard methods for extraction, as illustrated in the examples.

Using the lactic acid bacterium of the invention, a yield of 0.87 mol $mol^{-1}$ of glucose, and a titer of 78 mM diacetyl was achieved. This productivity greatly exceeded that reported for other diacetyl producing microorganisms.

IV Methods for Producing a Micro-organism of the Invention

Deletion of endogenous genes in a host lactic acid bacterium to obtain a genetically modified lactic acid bacterium according to the invention can be achieved by a variety of methods, for example by transformation of the host cell with linear DNA fragments containing a locus for resistance to an antibiotic, or any other gene allowing for rapid phenotypic selection, flanked by sequences homologous to closely spaced regions on the cell chromosome on either side of the gene to be deleted, in combination with the immediate subsequent deletion or inactivation of the recA gene. By selecting for a double-crossover event between the homologous sequences, shown by the antibiotic resistance or other detectable phenotype, a chromosome disruption can be selected for which has effectively deleted an entire gene. Inactivation or deletion of the recA gene prevents recombination or incorporation of extrachromosomal elements from occurring, thereby resulting in a bacterial strain which is useful for screening for functional activity or production of genetically engineered proteins in the absence of specific contaminants.

An alternative method for the deletion of genes in order to produce the lactic acid bacterium of the invention employs the non-replicating vector pCS1966. This method involves PCR-amplifying 800 base pairs (bp) dsDNA molecules, corresponding to DNA regions located upstream and downstream of the gene to be deleted, and inserting the amplified molecules into pCS1966 using restriction enzymes and T4 ligase. The recombinant plasmid is then introduced into *L. lactis*, where integration gave rise to erythromycin resistance. Subsequently, counter selection is performed in the presence of 5-fluoroorotate (5FO) where excision and loss of the plasmid gives rise to 5FO resistance. This method for the deletion of ldhX, ldhB, ldh, pta, adhE, butBA, aldB and noxE from *L.lactis* is described in further detail Example 1.

The deletion of endogenous genes in a host lactic acid bacterium to obtain a genetically modified lactic acid bacterium according to the invention can also be achieved by the more traditional approach involving mutagenesis and screening/selection. For instance, LDH (lactate dehydrogenase) mutants can be screened out using solid medium containing 2,3,5-triphenyl tetrazolium following mutagenesis using for instance N-methyl-N'-nitro-N-nitrosoguanidine (NTG) or UV radiation. Alternatively, after mutagenesis, low-lactic acid producing strains can be selected using a combination of bromide and bromate as described by Han et al., 2013. ALDB (α-acetolactate decarboxylase) mutants can be obtained easily after mutagenesis, for instance using NTG, or grown in the medium containing an unbalanced concentration of leucine versus valine and isoleucine in the medium (Goupil et al., 1996). ADHE (ethanol dehydrogenase) mutants can be screened and selected for in the presence of various concentrations of acetaldehyde. A phosphotransacetylase (E.C.2.3.1.8) mutant, induced by mutagenesis (e.g. using NTG), can subsequently be selected by penicillin enrichment in defined medium lacking lipoic acid. Under these conditions acetyl-CoA, needed for fatty acid biosynthesis, can only be obtained from acetate. Those cells that are able to assimilate acetate will proliferate and will subsequently be killed by the presence of penicillin. A mutant, having an inactivated phosphotransacetylase, can then be isolated by screening the survivors. An NADH oxidase (E.C. 1.6.3.4) mutant, induced by mutagenesis (e.g. using NTG), can be selected for based on oxygen level sensitivity. Diacetyl reductase (E.C.1.1.1.303), D-acetoin reductase and butanediol dehydrogenase (E.C. 1.1.1.4) mutants can be selected for after UV or chemical mutagenesis. For example, a filter assay for detecting BDH activity is described by Zhang et al. (2013) where single colonies are picked onto sterile membrane filters and then the filters are stained deep blue by treatment with 2,6-dichlorophenolindophenol. The filters are then floated on a solution of 2,3-butanediol, where only the BDH positive strains turn white, allowing the selection of BDH deficient mutants.

By combining the different approaches mentioned, a non-GMO diacetyl producer is readily obtainable. Accordingly, a genetically modified lactic acid bacterium of the invention is characterised by the deletion or knockout of endogenous genes in the lactic acid bacterium, where the functional deletion or functional knockout can also be obtained by means of induced mutagenesis and screening/selection.

V A Method of Detecting Diacetyl Production

Methods for detecting and quantifying diacetyl produced by a micro-organism of the invention include high performance liquid chromatography (HPLC) combined with Refractive Index detection to identify and quantify diacetyl (as describe by Benson et al., 1996), relative to a standard, as described and illustrated in the examples.

VI Use of the Genetically Modified Micro-organism of the Invention for Production of a Food Product Fermented food products rely on diacetyl produced during fermentation for their typical "butter" flavor and aroma; and the absence of this flavor reduces consumer appeal. *Lactococci*, typically used in the manufacture of milk products, can reduce diacetyl to acetoin and 2,3-butandiol, even at low temperatures, and thereby reduce product quality. Use of the genetically modified micro-organism of the invention overcomes this problem, since the micro-organism produces the desired diacetyl during fermentation in the production of the milk product; while the product can subsequently be safely stored without risk of a reduction of diacetyl content. Accordingly, the present invention encompasses both the production of a fermented food product using the genetically modified micro-organism of the invention; and a fermented milk product comprising the genetically modified micro-organism of the invention. Examples of fermented food products include: cottage cheese, yogurt, sour cream, and kefir.

EXAMPLES

Example 1

Genetic Modification of a *Lactococcus lactis* Strain for Production of Diacetyl The genetic modifications required to produce a *Lactococcus lactis* strain that is capable of producing diacetyl from glucose and to efficiently direct the flux towards this compound include the inactivation of all alternative product pathways, as described below.

1.1 Host Strains and Plasmids:

The plasmid-free strain *Lactococcus lactis* subsp. *cremoris* MG1363 (Gasson, 1983) or derivatives thereof were used as the parent strain for the genetic construction of a strain capable of producing diacetyl. *E. coli* strain ABLE-C (*E. coli* C lac(LacZ-)[Kanr McrA- McrCB- McrF- Mrr- HsdR (rk-mk-)][F' proAB lacIqZΔM15 Tn10(Tetr)]) (Stratagene) was used for cloning purposes. The plasmid pCS1966 (Solem et al., 2008), was used for the purpose of deleting various genes in *L. lactis*.

1.2 DNA Techniques:

All manipulations were performed according to Sambrook et al., 1989. PCR primers used can be seen in TABLE 1. PfuX7 polymerase (Nørholm, 2010) was used for PCR applications. Chromosomal DNA from *L. lactis* was isolated using the method described for *E. coli* with the modification that cells were treated with 20 μg of lysozyme per ml for 2 hours before lysis. Cells of *E. coli* were transformed using electroporation. Cells of *L. lactis* were made electro-competent by growth in GM17 medium (Terzaghi et al., 1975) containing 1% glycine and transformed by electroporation as previously described by Holo and Nes (1989). The plasmid vector pCS1966 (Solem et al., 2008) was used for deleting genes in *L. lactis*. Plasmids employed for deleting chromosomal genes were prepared by PCR amplifying approximately 800 base pairs (bp) regions upstream and downstream of the *L. lactis* chromosomal region to be deleted using the PCR primers and chromosomal DNA isolated from *L. lactis*. The primers used for amplifying the upstream and downstream regions are indicated in TABLE 1 as "geneX ups." and geneX dwn". The amplified fragments and the plasmid, pCS1966, were then digested with the respective restriction enzymes indicated in the primer table, prior to inserting the fragment into the plasmid. The resulting plasmids were transformed into the parent strain individually and gene deletion was performed as described by Solem C, et al. (2008). Specifically, the plasmids were transformed into the strains via electroporation, and the strains comprising the plasmids integrated into the chromosome were selected for on GM17 agar plates (Difco Cat. No. 218571: M17 broth from Becton, Dickinson and Company) supplemented with glucose and erythromycin. Afterwards, the transformants were purified and plated on SA glucose plates supplemented with 5-fluoroorotate, thereby selecting for strains in which the plasmid had been lost by homologous recombination. The successful deletions were verified by PCR (Solem et al., 2008).

TABLE 1

Primers

| Primer name | Primer use | Primer sequence (5'→3') |
|---|---|---|
| 43 (T3) | Verify insert in pCS1966 | AATTAACCCTCACTAAAGGG [SEQ ID NO: 137] |
| 603 | Verify insert in pCS1966 | ATCAACCTTTGATACAAGGTTG [SEQ ID NO: 138] |
| 710 | SP-ldh, XbaI | CTAGTCTAGANNNNNAGTTTATTCTTGACANNNNNNNNNNNN NNTGRTATAATNNNNAAGTAATAAAATATTCGGAGGAATTTT GAAATGGCTGATAAACAACGTAAG [SEQ ID NO: 139] |
| 768 | ldhB ups., PstI | AATTCCTGCAGCATATTAAATAATGAACAAGTCATTC [SEQ ID NO: 140] |
| 769 | ldhB ups., BamHI | TAGTGGATCCTGGTAAATCCAAACACAACAAC [SEQ ID NO: 141] |
| 770 | ldhB dwn., PstI | AATTCCTGCAGTAATTTCCAGCTCTTACAATAAC [SEQ ID NO: 142] |
| 771 | ldhB dwn., XhoI | GACCTCGAGTCAGAAACTTTCTTTACCAGAG [SEQ ID NO: 143] |
| 772 | pCS1966, BamHI | GCGGGGATCCACTAGTTCTAG [SEQ ID NO: 144] |
| 773 | pCS1966, XhoI | ATACCGTCGACCTCGAG [SEQ ID NO: 145] |
| 774 | ldhX ups., BamHI | TAGTGGATCCCTGTTTCAGGTCTTGGATAG [SEQ ID NO: 146] |
| 775 | ldhX ups., EcoRI | CCGATGAATTCTCATTAGCACGTTTAACAAGAG [SEQ ID NO: 147] |
| 776 | ldhX dwn., EcoRI | CCGATGAATTCATCAGCGTAGTCTGCTGC [SEQ ID NO: 148] |
| 777 | ldhX dwn., KpnI | CGGGGTACCATTTAATCCTAAAGTCGTTATTAC [SEQ ID NO: 149] |
| 785 | ldh ups., EcoRI | CCGATGAATTCTTAAGTCAAGACAACGAGGTC [SEQ ID NO: 150] |
| 786 | ldh dwn, EcoRI | CCGATGAATTCGACCTTGTTGAAAAAAATCTTC [SEQ ID NO: 151] |
| 787 | ldh ups., BamHI | TAGTGGATCCGTACAATGGCTACTGTTAAC [SEQ ID NO: 152] |
| 788 | ldh dwn., XhoI | GACCTCGAGGATGAACAGACTTTTTTATTATAG [SEQ ID NO: 153] |
| 789 | Verify ldh deletion | AAAACCAGGTGAAACTCGTC [SEQ ID NO: 154] |
| 791 | adhB rev, PstI | TCGGACTGCAGTTAAAATGCTGATAAAAACAATTCTTC [SEQ ID NO: 155] |
| 827 | pCS1966, BamHI | ATACCGTCGACCTCGAG [SEQ ID NO: 156] |
| 828 | pCS1966, XhoI | CGATAAGCTTGATATCGAATTC [SEQ ID NO: 157] |
| 830 | adhB fwd, EcoRI | CCGATGAATTCTATAAGGAGAATTAGAATGGCAAGTAGTACA TTTT ATATTC [SEQ ID NO: 158] |
| 878 | pta ups., USER | ATCCCTCGGTTACAAGTTTCU [SEQ ID NO: 159] |
| 879 | pta dwn., USER | AGAAACTTGTAACCGAGGGAUAATAATAGATTGAAATTCTGT CAG [SEQ ID NO: 160] |
| 880 | pta ups., USER | ATTCGATATCAAGCTTATCGAUCAAAAATTGTGGTAGAATATA TAG [SEQ ID NO: 161] |

TABLE 1-continued

Primers

| Primer name | Primer use | Primer sequence (5'→3') |
|---|---|---|
| 881 | pta dwn., USER | AGGTCGACGGTATCGATAAUCCTAGTTCAATTGATGTGAC [SEQ ID NO: 162] |
| 882 | pCS1966, USER | ATCGATAAGCTTGATATCGAAU [SEQ ID NO: 163] |
| 883 | pCS1966, USER | ATTATCGATACCGTCGACCU [SEQ ID NO: 164] |
| 887 | noxE ups, USER | ATTCGATATCAAGCTTATCGAUATTTAAAAATGATTGCAACATATAAC [SEQ ID NO: 165] |
| 888 | noxE ups, USER | ATAGGTCTCCTTTAAATGTAAAAU [SEQ ID NO: 166] |
| 889 | noxE dwn, USER | ATTTTACATTTAAAGGAGACCTAUTAGAAATCTATCTGCTTGATAG [SEQ ID NO: 167] |
| 890 | noxE dwn, USER | AGGTCGACGGTATCGATAACGUCTTCACCGTCCATTTTGAC [SEQ ID NO: 168] |
| 891 | pTD6, USER | ACAGATTAAAGGTTGACCAGTAU [SEQ ID NO: 169] |
| 892 | pTD6, USER | ACCAATTCTGTGTTGCGCAU [SEQ ID NO: 170] |
| 893 | SP-dar-bdh, fwd. | ATGCGCAACACAGAATTGGUGGCCNNNNNAGTTTATTCTTGACANNNNNNNNNNNNNNNTGRTATAATNNNNAAGTAATAAAATATTCGGAGGAAT [SEQ ID NO: 171] |
| 894 | adhB rev., USER | ATACTGGTCAACCTTTAATCTGUTTAAAATGCTGATAAAAACAATTCTT [SEQ ID NO: 172] |
| 920 | pCS1966, USER | ATAAGCTUGATATCGAATTCCT [SEQ ID NO: 173] |
| 921 | pCS1966, USER | ATTCCCTTUAGTGAGGGTTAAT [SEQ ID NO: 174] |
| 926 | ldh rev, XhoI | TCGACCTCGAGTTTTTTATTTTTAGTTTTTAACTGCAG [SEQ ID NO: 175] |
| 927 | adhE ups., USER | ATGTGTACGUTCTCCTTTGTG [SEQ ID NO: 176] |
| 928 | adhE dwn., USER | ACGTACACAUATTATAGTATTTGGAACCGAAC [SEQ ID NO: 177] |
| 929 | adhE ups., USER | AAGCTTAUGGTCGTCTTGTTACTTGTG [SEQ ID NO: 178] |
| 930 | adhE dwn., USER | AAAGGGAAUTCTGCCGGAGCTATATATG [SEQ ID NO: 179] |
| 975 | dar-bdh rev. | TTAATTATACAACATTCCTCCATC [SEQ ID NO: 180] |
| 976 | butBA ups., PstI | AATTCCTGCAGATCTATACCTACTTGACCAGC [SEQ ID NO: 181] |
| 977 | butBA ups., BamHI | TAGTGGATCCGAGTATTCGCAAACCTTCAG [SEQ ID NO: 182] |
| 978 | butBA dwn., PstI | AATTCCTGCAGAATAAATGAATGAGGTAAGGTCTA [SEQ ID NO: 183] |
| 979 | butBA dwn., XhoI | GACCTCGAGTTTAAGAGATAAAAGGTTAATTGTG [SEQ ID NO: 184] |
| 991 | gusA MG1655 | GAATCGGTACCAATAAAATATTCGGAGGAATTTTGAAATGTTACGTCCTGTAGAAAC [SEQ ID NO: 185] |
| 992 | gusA MG1655 | GGACCGTACGTTAAAAAATAAAAAAGAACCCACTCGGGTTCTTTTTTTTATTGTTTGCCTCCCTGCTG [SEQ ID NO: 186] |
| 1057 | aldB ups., BamHI | TAGTGGATCCCTTAATTGCTGGAATCACTG [SEQ ID NO: 187] |

TABLE 1-continued

Primers

| Primer name | Primer use | Primer sequence (5'→3') |
|---|---|---|
| 1058 | aldB ups., PstI | AATTCCTGCAGATGATATTTCTCTTTTCTATCTCA [SEQ ID NO: 188] |
| 1059 | aldB dwn., PstI | AATTCCTGCAGAATTGCTTAAATTTCTTTAGCTAC [SEQ ID NO: 189] |
| 1060 | aldB dwn., XhoI | TCGACCTCGAGTTAGACGCTCGGGATAAAG [SEQ ID NO: 190] |
| 1112 | pCI372 | GCAACAACGTGCGCAAAC [SEQ ID NO: 191] |
| 1113 | pCI372 | CTGCAGGTCGACTCTAG [SEQ ID NO: 192] |
| 1117 | aldB fwd. | AATATTTTAGGACCCAATGATG [SEQ ID NO: 193] |
| 1119 | aldB rev | CGAGCTGGAAAGCTTTTATC [SEQ ID NO: 194] |
| 1130 | SP-ldhA E. coli, XbaI | CTAGTCTAGAGCNNAGTTTATTCTTGACANNNNNNNNNNN NNNNTGRTATAATNNNNAAGTAATAAAATATTCGGAGGAATT TTGAAATGAAACTCGCCGTTTATAG [SEQ ID NO: 195] |
| 1131 | ldhA rev, XhoI | TCGACCTCGAGAAGAATAGAGGATGAAAGGTC [SEQ ID NO: 196] |

1.3 Deleting Genes from the *Lactococcus lactis* subsp. *cremoris*

The following genes were deleted from the *Lactococcus lactis* subsp. *cremoris* parent strain ldhX, ldhB, ldh, pta, adhE, butBA, aldB and noxE. The genes were deleted using gene deletion plasmids derived from pCS1966 designated as: pCS4026 (ldhX), pCS4020 (ldhB), pCS4104 (ldh), pCS4230 (pta), pCS4273 (adhE), pCS4491 (butBA), pCS4495 (aldB) and pCS4256 (noxE), constructed as described above (Example 1.2).

Deletion of the genes from the *Lactococcus lactis* subsp. *cremoris* parent strain was verified by PCR amplification of the respective gene using primers 774/777 (ldhX), 769/771 (ldhB), 788/789 (ldh), 880/881(pta), 929/930 (adhE), 977/979 (butBA), 1117/1119 (aldB), 887/890 (noxE).

Strains and Plasmids

| Designation | Genotype or description | Reference |
|---|---|---|
| *L. lactis* strains | | |
| CS4363 | MG1363 Δ³ldh Δpta ΔadhE | Solem et al., 2013 |
| CS4311 | MG1363 Δ³ldh Δpta ΔadhE pCS4268 | This work |
| CS4502 | *MG1363 Δ³ldh Δpta ΔadhE ΔbutBA pCS4268 | This work |
| CS4525 | *MG1363 Δ³ldh Δpta ΔadhE ΔbutBA ΔaldB pCS4268 | This work |
| CS4554 | MG1363 ΔldhX ΔldhB Δpta ΔadhE ΔbutBA ΔaldB ΔnoxE pCS4268 | This work |
| CS4562 | MG1363 Δ³ldh ΔadhE ΔbutBA ΔaldB ΔnoxE pCS4564 | This work |
| CS4615 | MG1363 Δ³ldh Δpta ΔadhE ΔbutBA ΔaldB ΔnoxE pCS4564 | This work |
| CS4634 | MG1363 pCS4634 (pCI372::SP-budC-bdh) | This work |
| CS4701 | MG1363 Δ³ldh Δpta ΔadhE ΔbutBA ΔaldB ΔnoxE pCS4634 | This work |
| CS4616m | MG1363 Δ³ldh Δpta ΔadhE ΔbutBA ΔaldB ΔnoxE | This work |
| CS4616m2 | MG1363 Δ³ldh Δpta ΔadhE ΔbutBA ΔaldB ΔnoxE pLP712 | This work |
| Plasmids | | |
| pG⁺host8 | *E. coli*/*L. lactis* shuttle vector, Tet^R, thermosensitive replicon | Maguin et al., 1996 |
| pCS4268 | pG⁺host8::SP-ldh (*L. lactis*) | This work |
| pCS4564 | pG⁺host8::SP-ldhA (*E. coli*) | This work |
| pCI372 | *E. coli*/*L. lactis* shuttle vector, Cam^R | Hayes et al., 1990 |
| pCS4518 | pCI372::gusA | This work |
| pCS4634 | pCS4518::SP-budC-bdh | This work |
| pLP712 | The lactose plasmid, isolated from NCDO712 | Wegmann et al., 2012 |

*Indicates that the chromosomal ldh may have reverted to wild-type by recombination with pCS4268; Δ3ldh = Δldh ΔldhX ΔldhB; SP signifies Synthetic Promoter.

The strain containing the three lactate dehydrogenase deletions (ldh, ldhB, ldhX) was named CS4099 or MG1363Δ3ldh. CS4363 was derived from CS4099, by additionally the deleting a phosphotransacetylase gene, pta and adhE. Strains deleted for the three ldh genes had poor growth properties (CS4363); so to facilitate growth of CS4363 and its subsequent genetic modification, the CS4363 strain was transformed with a plasmid (pCS4268) with a thermosensitive replicon carrying *L. lactis* ldh expressed from a synthetic promoter (SP), to give strain CS4311. The plasmid was prepared as follows: an SP-ldh fragment was amplified from *L. lactis* using primers 710/926, was digested with XbaI/XhoI and inserted into pG⁺host8 plasmid (Maguin et al., 1996) digested with the same enzymes, and the ligated plasmid was then introduced into the CS4363 strain to give rise to CS4311. Strain CS4502 was derived from strain CS4311 by deletion of butBA, and CS4525 was derived from strain CS4502 by deletion of deleted aldB. CS4554 was derived from strain CS4525 by deletion of noxE, but in this strain ldh was found to have reverted to wild-type (ldh) due to a recombination event between the deleted ldh locus and the intact ldh gene on the pG⁺host8 plasmid (pCS4564). CS4562 was derived from strain CS4554, lacking the pG+host8 plasmid, but substituted by another pG+host8 plasmid carrying an *E. coli* ldhA (pCS4564). The plasmid pCS4564 was constructed in the following manner: SP-ldhA was amplified from *E. coli* using 1130/1131, digested with XhoI/XbaI and inserted into pG+host8 digested with the same enzymes. The chromosomal ldh was then deleted from CS4562 thus giving rise to CS4615 (MG1363 Δldh ΔldhX ΔldhB Δpta ΔadhE ΔbutBA ΔaldB ΔnoxE pCS4564); whereafter pCS4564 was lost by incubation at 36° C. in the presence of 5 µg/ml hemin to yield CS4616m.

1.4 Cultivation of the Genetically Engineered Strain Lactic Acid Bacterium

*L. lactis* were grown aerobically at 30° C. in rich M17 broth (Terzaghi et al., 1975) supplemented with 2% (w/v) glucose and different concentrations of hemin in shaken 250 ml conical flasks. When required, antibiotics were added in the following concentrations: erythromycin: 200 µg/ml for *E. coli* and 5 µg/ml for *L. lactis*, tetracycline: 8 µg/ml for *E. coli* and 5 µg/ml for *L. lactis*, chloramphenicol: 20 µg/ml for *E. coli* and 5 µg/ml for *L. lactis*.

1.5 Measurement of NADH and $NAD^+$ in the Genetically Engineered Strain Lactic Acid Bacterium

*L. lactis* cell culture harvested in the mid-exponential growth phase ($OD_{600\,nm}$=0.6) was frozen in liquid nitrogen and stored at −20° C. Extraction and quantification of NADH and $NAD^+$ were performed using the kit $NAD^+$/NADH-Glo™ Assay (Promega) according to the instructions. Intracellular NADH and $NAD^+$ concentrations were estimated by assuming that 1 g (dry weight) of cells corresponded to 1.67 ml of intracellular volume and the cell density of 1 $OD_{600\,nm}$ corresponds to 0.35 g/l dry cell mass.

1.6 Measurement of Fermentation Products of the Genetically Engineered Strain Lactic Acid Bacterium Glucose, lactate, and ethanol were detected and quantitated using the Ultimate 3000 high-pressure liquid chromatography system (Dionex, Sunnyvale, USA) equipped with a Aminex HPX-87H column (Bio-Rad, Hercules, USA) and a Shodex RI-101 detector (Showa Denko K.K., Tokyo, Japan). Pyruvate was detected and quantitated using the DAD-3000 diode array detector (Dionex, Sunnyvale, USA). The column oven temperature was set at 60° C. with a mobile phase of 5 mM $H_2SO_4$, and the flow rate was 0.5 ml/min. Acetoin and α-acetolactate were measured colorimetrically based on Westerfeld et al. (1945). Diacetyl concentration was determined as described by Benson et al (1996).

1.7 Properties of the Genetically Engineered Strain Lactic Acid Bacterium

Figure 1:
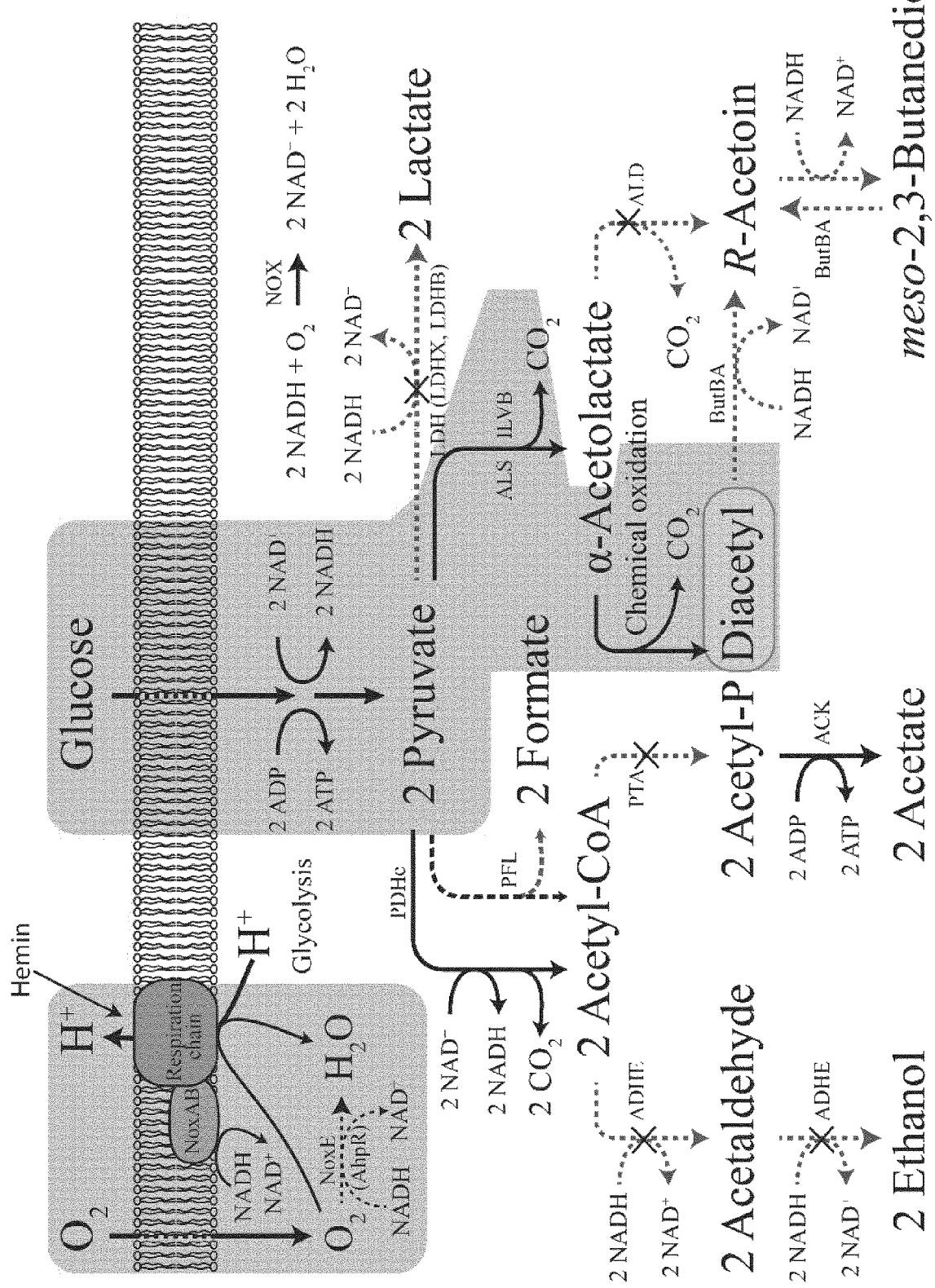
FIG. 1. Cartoon showing the modifications of the metabolic pathway of a lactic acid bacterium for overproduction of diacetyl. (A) Respiration is coupled to glycolysis for the production of diacetyl, as highlighted in the background. The competing pathways were inactivated, which is indicated as dotted lines. Abbreviations: LDH, lactate dehydrogenase; ALS (ILVB), acetolactate synthase; ALD, acetolactate decarboxylase; ButBA, diacetyl reductase and butanediol dehydrogenase; PDHc, pyruvate dehydrogenase complex; PFL, pyruvate formate lyase; PTA, phosphotransacetylase; ADHE, alcohol dehydrogenase; ACK, acetate kinase; Nox, NADH oxidase.

A strain of *Lactococcus lactis* subsp. *cremoris*, from which the lactate dehydrogenases (ldh, ldhB, ldhX), phosphotransacetylase (pta), and alcohol dehydrogenase (adhE) have been inactivated by deletion of their genes, results in an efficient redirection of metabolic flux towards diacetyl. However, the main fermentation product of this strain was R-acetoin, and additionally it was only able to grow aerobically. When the chromosomally encoded LDH and PTA genes in the strain were also inactivated, this led to a large decline in specific growth rate and reduced the transformation efficiency needed for the succeeding molecular manipulations. Transformation with of a plasmid having a thermosensitive replicon expressing LDH (pCS4268 or pCS4564) into the strain allowed for its growth under anaerobic conditions and for the further engineering of a strain for homo-diacetyl production by deletion of the native aldB gene and native butBA operon (FIG. 1).

Figure 2:
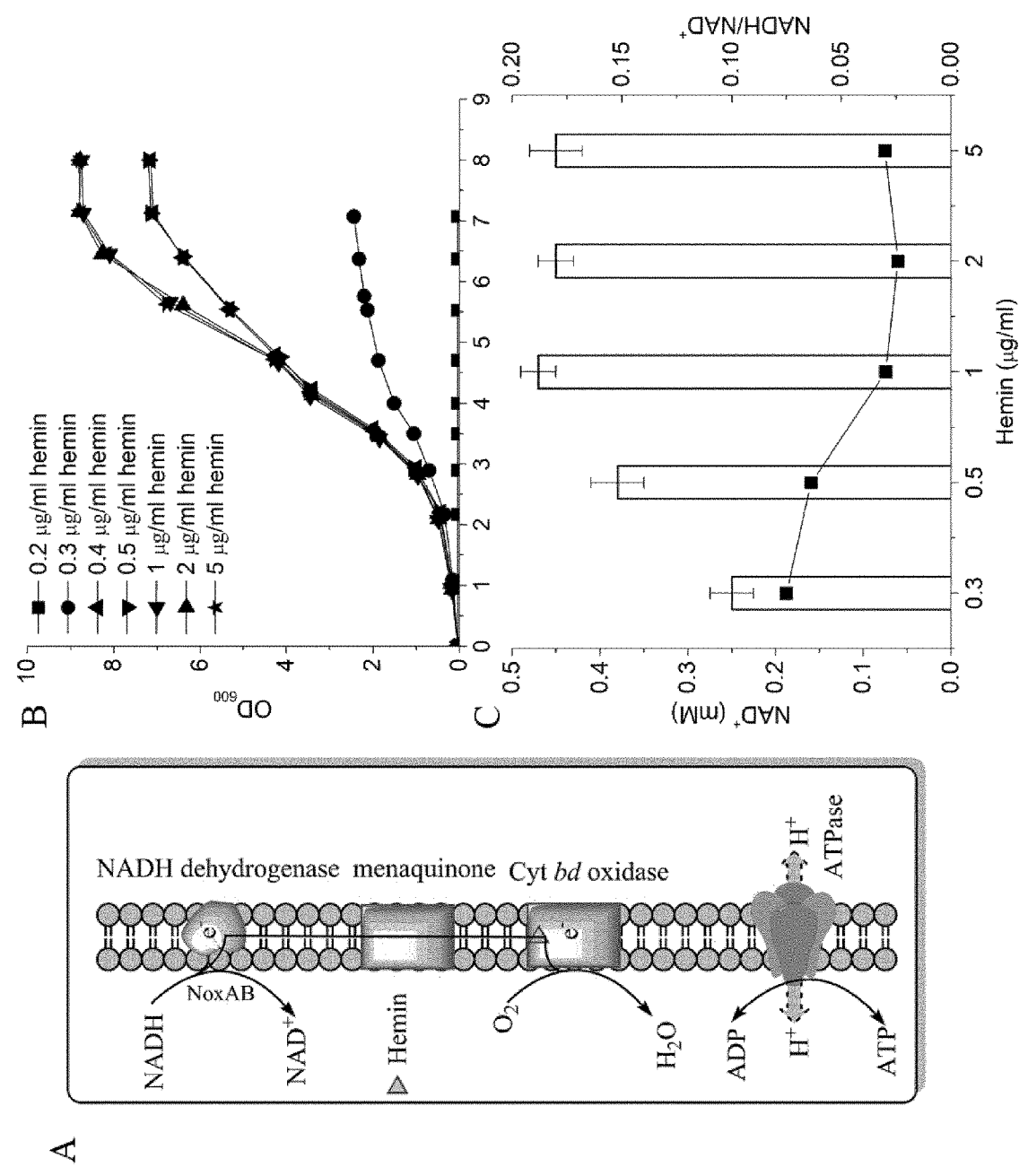
FIG. 2. Activation of respiration restores growth of the lactic acid bacterium of the invention.

In strains deleted for native aldB gene, the formation of diacetyl from acetolactate is dependent on non-enzymatic oxidative decarboxylation, which requires aerobic growth conditions. However, it was not possible to produce *L. lactis* strains for diacetyl production having the genotype (MG1363 Δ3ldh Δpta ΔadhE ΔbutBA ΔaldB). Under aerobic conditions a large portion of NADH is consumed in $NAD^+$ regeneration and $O_2$ elimination due to NADH oxidase activity in *L. lactis*. The main source of NADH oxidase activity in *L. lactis* is attributed to NoxE (>95%), which is a water-forming NADH oxidase. Likely, NoxE activity is insufficient to provide the cofactor balance and oxidative stress resistance required in a *L. lactis* strain for diacetyl production. Accordingly, in order to produce a *L. lactis* strain for diacetyl production, the NoxE gene was deleted; and instead methods for activating respiration were explored. The *L. lactis* respiratory chain in the cell membrane includes electron donor (NoxAB), electron transfer (menaquinone) and electron acceptor (Cyt bd). Hemin, which is not synthesized in *L. lactis*, is an essential cofactor for Cyt bd activity, and could be used to activate respiration in the *L. lactis* strains engineered for diacetyl production. An external supply of hemin would contribute to NAD+/NADH balance, proton translocation, high biomass yield and low oxidative stress. Thus the viable *L. lactis* strain CS4616m (MG1363 Δ3ldh Δpta ΔadhE ΔbutBA ΔaldB ΔnoxE) was metabolic engineered for diacetyl production under aerobic conditions, where hemin-activated respiration is coupled to glycolysis within the cell (FIG. 2A).

1.8 Introducing Genes Encoding the Lactose Catabolism Pathway Into *Lactococcus lactis* subsp. *cremoris* Strain CS4616m The wild type strain *L. lactis* MG1363, and its derivatives described herein, are plasmid-free strains that cannot utilize lactose as a carbon source. The *Lactococcus* plasmid, pLP712 (55.395 kbp), comprises genes encoding the entire lactose catabolism pathway (Wegmann et al., 2012). The lactose-metabolism plasmid pLP712 (55,395 bp) was extracted from the dairy isolate NCDO712 based on the method of Andersen (1983); and then transformed into *L. lactis* strain CS4616m to give strain CS4616m2.

The lactose catabolism pathway genes located on the pLP712 plasmid (FIG. 2) are as follows:

1. the lacAB genes encoding two subunit polypeptides that together have galactose-6-phosphate isomerase activity (EC 5.3.1.26); wherein the first subunit polypeptide has an amino acid sequence of SEQ ID NO: 202 encoded by the *L. lactis* lacA gene; and the second subunit polypeptide has an amino acid sequence of SEQ ID NO: 204 encoded by the *L. lactis* lacB gene;

2. the lacC gene encoding a polypeptide having D-tagatose-6-phosphate kinase activity (EC 2.7.1.114); wherein the polypeptide has an amino acid sequence of SEQ ID NO: 206);

3. the lacD gene encoding a polypeptide having tagatose 1,6-diphosphate aldolase activity (EC 4.1.2.40); wherein the polypeptide has an amino acid of SEQ ID NO: 208;

4. the lacEF genes encoding a two polypeptide components together having lactose-specific phosphotransferase system (PTS) activity (EC 2.7.1.69); wherein the first polypeptide component is a phosphotransferase system EIICB component having an amino acid sequence of SEQ ID NO: 210, encoded by the *L. lactis* lacE gene; and the second polypeptide component is a phosphotransferase system EIIA component having an amino acid sequence of SEQ ID NO: 212, encoded by the *L. lactis* lacF gene; and 5. the lacG gene encoding a polypeptide having phospho-β-D-galactosidase activity (EC 3.2.1.85); wherein the polypeptide has the amino acid sequence of the phospho-β-D-galactosidase of SEQ ID NO: 214; and 6. the lacR gene encoding a lactose transport regulator of SEQ ID NO: 216

Example 2

Respiration-dependent Growth of a Genetically Engineered *Lactococcus lactis* Strain Adapted for Production of Diacetyl The genetically engineered *L. lactis* strain CS4616m was unable to grow anaerobically, implying that it had lost the capacity for fermentation. However, growth of the *L. lactis* strain was restored under aerobic conditions when hemin was present (FIG. 2B). The specific growth rate and final biomass density ($OD_{600\ nm}$) of the *L. lactis* strain increased in response to hemin concentrations of above 0.2 µg/ml, where a growth rate of 0.8 $h^{-1}$ and cell density of $OD_{600\ nm}$ 8.5 was measured using a growth medium comprising 2% glucose, hemin levels were 1 µg/ml or above. Elevated hemin concentrations (circa 10 µg/ml or above) had a significant negative effect on cell growth (data not shown).

The measured intracellular $NAD^+$ concentration of the *L. lactis* strain increased from 0.25 mM when grown in the presence of 0.3 µg/ml hemin to 0.47 mM in the presence of 1 µg/ml hemin, while the NADH/NAD+ ratio sharply decreased from 0.07 to 0.03 (FIG. 2C). Hemin concentrations of above 1 µg/ml (e.g. 5 µg/ml) did not further increase the final cell biomass obtained during culture, nor the NADH/NAD+ ratio. In the *L. lactis* respiration chain (FIG. 2A), electrons are transferred from NADH dehydrogenase (NoxAB), menaquinone to Cyt bd oxidase in the presence of hemin. The observed growth and NADH/NAD+ ratio of genetically engineered strain CS4616m induced by hemin is consistent with the theory that NADH generated by the glycolysis pathway can be replenished through respiration and that suitable hemin activators can be used to fine-tune respiration and restore cell growth in this strain.

Example 3

Growth and Diacetyl Production of a Genetically Engineered *Lactococcus lactis* Strain

3.1 Diacetyl Production from Glucose in the Presence of Hemin

When *L. lactis* strain CS4616m was grown in the presence of 1 µg/ml hemin the production of diacetyl increased in response to the concentration of glucose in the growth medium (FIG. 3A-D). While 5.3 mM diacetyl was formed after 15 h fermentation at the cost of 25 mM glucose; the amount produced increased to 10, 16 and 25 mM diacetyl respectively corresponding to the consumption of 50, 75 and 108 mM glucose. No detectable lactate, acetate, ethanol or formate were found in the fermentation broth, small amounts of pyruvate was detected, and the combined yield for acetolactate, acetoin and diacetyl was close to 0.9 mol mol−1 for glucose (Table 2).

Carbon flux in *L. lactis* strain CS4616m is effectively redirected to the acetolactate-formation pathway when the cells are grown on glucose supplemented with hemin. The measured diacetyl yield was around 0.2 mol $mol^{-1}$, while acetolactate was observed to accumulate (Table 2). Small amounts of acetoin were detected, which may be attributed to the activity of an ALDC (acetolactate decarboxylase C), or to chemical non-oxidative decarboxylation.

When grown with 108 mM glucose in the presence of 1 µg/ml hemin, the *L. lactis* strain CS4616m accumulated acetolactate (FIG. 4A). An acetolactate concentration of 83.5 mM was detected after 11 h fermentation, which then it decreased to 65 mM, accompanied with the co-production of 25 mM diacetyl after 14.8 h. This indicated that the non-enzymatic oxidative transformation from acetolactate to diacetyl was a limiting step.

3.2 Metal Ions Enhance Diacetyl Production from Glucose in the Presence of Hemin The addition of the metal ions $Fe^{3+}$, $Fe^{2+}$ and $Cu^{2+}$ were found to significantly increase diacetyl production by cells of the *L. lactis* strain CS4616m. When the cells entered the stationary phase, different concentrations of these metal catalysts were added to the cultivation medium. As shown in FIG. 4B, 30 mM $Fe^{3+}$ caused a significant increase in diacetyl production; whereby a diacetyl concentration of 85 mM diacetyl was detected after 2 h, and 95 mM was achieved after 4 h. The yield and productivity for diacetyl production was as high as 0.87 mol $mol^{-1}$ glucose and 0.58 g/L·h based on 4 h data. $Fe^{2+}$ also enhanced diacetyl production, but over a longer time period, yielding 78 mM diacetyl after 4 h in the presence of 20 mM $Fe^{2+}$ (FIG. 4C). $Cu^{2+}$ was the most effective metal ion for accelerating diacetyl production (FIG. 4D), with the production of 78 mM diacetyl after 1 h in the presence of 30 mM $Cu^{2+}$ and the productivity reached 0.619 g/L·h. Accordingly, the metal ions $Fe^{3+}$ and $Cu^{2+}$ were more effective than $Fe^{2+}$ for enhancing diacetyl production.

The observed high yields of diacetyl by cells of the *L. lactis* strain CS4616m are achieved by the addition of metal ions to the cells after they have reached the desired cell biomass. Addition of metal ions during the growth phase of a *L. lactis* strain CS4616m cell culture was observed to inhibit its growth. Thus $Cu^{2+}$ totally abolished cell growth; while $Fe^{3+}$ and $Cu^{2+}$ (10 or 20 mM) when present in the growth medium from the beginning of the growth phase inhibited growth. The final biomass of a culture grown in the presence of 10 mM $Fe^{3+}$ was only 3.3 ($OD_{600\ nm}$) (FIG. 5B) compared to 8.5 ($OD_{600\ nm}$) in the absence of a $Fe^{3+}$ supplement (FIG. 5A). Furthermore, diacetyl itself was also found to inhibit cell growth of the *L. lactis* strain CS4616m cell culture (FIG. 5A). In summary, for optimal diacetyl production, *L. lactis* strain CS4616m should be cultivated under aerobic conditions in the presence of a carbon source,

TABLE 2

Fermentation products of *L. lactis* strain CS4616m grown with 1 µg/ml hemin.

| Initial Glu | Pyruvate | Lactate | Acetolactate | Acetoin | Diacetyl | Yield (mol $mol^{-1}$)[1] | Yield (mol $mol^{-1}$)[2] |
|---|---|---|---|---|---|---|---|
| 25 | 0.6 | ND | 17 | ND | 5.3 | 0.89 | 0.21 |
| 50 | 1.5 | ND | 31 | 3 | 10 | 0.88 | 0.2 |
| 75 | 3.7 | ND | 42 | 5.3 | 16 | 0.85 | 0.21 |
| 108 | 5.7 | ND | 65 | 7.1 | 25 | 0.89 | 0.23 |

Fermentation product (mM) profiles detected after 15 h fermentation.
[1] yield for the total acetolactate, diacetyl and acetoin.
[2] yield for diacetyl.

e.g. glucose, in the presence of hemin until a sufficient biomass has been reached, followed by the addition of metal ions, preferably $Fe^{3+}$ or $Cu^{2+}$), and maintaining the aerobic conditions, in order for the accumulated acetolactate to be converted into diacetyl with high yield. The observed increase in diacetyl production by cells of the *L. lactis* strain CS4616m in response to $Fe^{3+}$, $Fe^{2+}$ and $Cu^{2+}$ is consistent with the finding that these metal ions serve as accelerators of the non-enzymatic oxidative decarboxylation flux from acetolactate to diacetyl. Optionally, once a sufficient biomass of the genetically modified *Lactococcus lactis* has been obtained following cultivation in the presence of a source of protoporphyrin IX or iron-containing porphyrin (e.g. hemin), the conversion of accumulated acetolactate can be accelerated by elevating the temperature of the culture or culture medium, for example to 60-65 degrees centigrade.

Example 4

Development of a Lactose Medium for Production of Diacetyl from Lactose by Genetically Modified *Lactococcus lactis* Strain of the Invention Waste stream residual whey permeate (RWP) is the permeate mother liquor obtained after extracting lactose from whey permeate. The composition of the RWP, which was supplied by Arla Foods Ingredients Group P/S was determined and shown in Table 4. The sugar components of a filtered sample of RWP were determined as described in example 1.8, and the amino acid composition was determined by the steps of hydrolysis of the filtered sample with 6 M HCl, derivatization of the amino acids using o-phthaldialdehyde, and analysis of the derivatives using ion exchange chromatography as described by Barkholt et al., (1989).

TABLE 4

The composition of residual whey permeate[a]

| Composition | Concentration |
|---|---|
| Lactose | 150 gL |
| Galactose | 3 gL |
| Aspartate | 0.252 mM (mmol/L) |
| Threonine | 0.076 mM |
| Serine | 0.088 mM |
| Glutamate | 1.464 mM |
| Proline | 0.384 mM |
| Glycine | 0.904 mM |
| Alanine | 0.24 mM |
| Cysteine | 0.096 mM |
| Valine | 0.072 mM |
| Methionine | 0.124 mM |
| isoleucine | 0.04 mM |
| Leucine | 0.092 mM |
| Histidine | 0.208 mM |
| Lysine | 0.304 mM |
| Arginine | 0.096 mM |

[a]Residual whey permeate is a concentrate of the residue remaining after lactose extraction from whey permeate.

In view of the relatively low amino acid content of RWP, a nitrogen source should be added to the RWP, to support growth and diacetyl production.

Corn steep liquor (CSL) is a cheap source of complex nitrogen. CSL was purchased from Sigma-Aldrich (St. Louis, Mo.) with a 40-60% solids content. The RWP medium was supplemented with either non-treated CSL, or acid treated CSL in order to enhance the availability of the amino nitrogen content of the CSL. Samples of CSL were subjected to various degrees of acid hydrolysis. The acid hydrolysis was performed with very small amounts of sulfuric acid (0.05-0.5% concentrated $H_2SO_4$ added to CSL having a 20-30% w/v solids content). The following hydrolysis conditions were applied to produce corn steep liquor hydrolysates (CSLH). H1 condition: original CSL was diluted 2 times with water and then 50 µl concentrated sulfuric acid was mixed with 100 ml diluted CSL. The mixture was kept at 121° C. for 15 mins and subsequently the pH was adjusted to 6.8-7.1 with the addition of 10 M NaOH solution.

Analysis of the free amino acid composition of CSL revealed that hydrolysis of corn steep liquor increases the free amino acid content of CSL by circa 2 fold in comparison with untreated corn steep liquor.

TABLE 5

Free amino acid composition of CSL before and after hydrolysis

| Amino acids Unit (mM) | CSL 25% (wv) | Hydrolyzed CSL (H1) 25% (wv) |
|---|---|---|
| Aspartate | 1.8 | 3.6 |
| Glutamate | 0.9 | 2 |
| Asparagine | 1.4 | 3 |
| Glutamine | 0.8 | 2.1 |
| Histidine | 6.1 | 11 |
| Arginine | 4.5 | 10.5 |
| Alanine | 2.1 | 5 |
| Tyrosine | 0.8 | 2.1 |
| Cysteine | 3.7 | 5.7 |
| Valine | 2.1 | 4.8 |
| Isoleucine | 1.8 | 3.6 |
| Leucine | 0.8 | 2.5 |
| Methionine | 0.1 | 1.2 |

Example 5

A Method for Producing Diacetyl from Lactose Using the Genetically Engineered *Lactococcus lactis* Strain of the Invention Fermentation was performed using CS4616m2 (MG1363 $\Delta^3$ldh $\Delta$pta $\Delta$adhE $\Delta$butBA $\Delta$aldB $\Delta$noxE pLP712) in diluted residual whey permeate (RWP) medium with 1 µg/ml hemin supplemented with different nitrogen sources. As shown in table 3, the combination of diluted RWP and 2% (w/v) yeast extract stimulated the highest diacetyl production (57 mM or 4.9 g/L). The hydrolyzed corn steep liquor is also a good nitrogen source (Hydrolysis condition H1) for supporting cell growth and diacetyl production.

TABLE 3

Diacetyl production from residual whey permeate medium

| Strain | Medium | $OD_{600}$ | Diacetyl (mM) |
|---|---|---|---|
| CS4616m2 | Diluted RWP (including 20 gL lactose) and 1% (wv) yeast extract and 1 µg/ml hemin and 30 mM $Fe^{3+}$ [a] | 3.7 | 39 |
| CS4616m2 | Diluted RWP (including 20 gL lactose) and 2% (wv) yeast extract and 1 µg/ml hemin and 30 mM $Fe^{3+}$ [a] | 5.7 | 57 |

TABLE 3-continued

Diacetyl production from residual whey permeate medium

| Strain | Medium | $OD_{600}$ | Diacetyl (mM) |
|---|---|---|---|
| CS4616m2 | Diluted RWP (including 20 gL lactose) and 5% (wv) hydrolyzed corn steep liquor[b] and 1 μg/ml hemin and 30 mM $Fe^{3+}$ [a] | 3.5 | 41 |

[a] 30 mM $Fe^{3+}$ was added into the medium after 20 h, at which time the culture had entered the stationary phase.
[b] Hydrolysis condition: the original CSL (about 50% (wv) solid content) was diluted 2 times with water and then 50 μl concentrated sulfuric acid was mixed with 100 ml diluted CSL. The mixture was kept at 121° C. for 15 mins and subsequently pH was adjusted to 6.8-7.1 with the addition of 10M NaOH solution.

REFERENCES

Benson, K. H., Godon, J. J., Renault, P., Griffin, H. G. & Gasson, M. J. Effect of ilvBN-encoded α-acetolactate synthase expression on diacetyl production in Lactococcus lactis. Appl. Microbiol. Biotechnol. 45, 107-111 (1996).

Holo, H. & Nes, I. High-frequency transformation, by electroporation, of Lactococcus lactis subsp. cremoris grown with glycine in osmotically stabilized media. Appl. Environ. Microbiol. 55, 3119-3123 (1989).

Nørholm, M. H. H. A mutant Pfu DNA polymerase designed for advanced uracil-excision DNA engineering. BMC Biotechnol. 10, 21 (2010).

Sambrook, J. & Russell, D. Molecular Cloning: A Laboratory Manual. (Cold Spring Harbor Laboratory Press, 2001).

Solem, C., Defoor, E., Jensen, P. R. & Martinussen, J. Plasmid pCS1966, a new selection/counterselection tool for lactic acid bacterium strain construction based on the oroP gene, encoding an orotate transporter from Lactococcus lactis. Appl. Environ. Microbiol. 74, 4772-4775 (2008).

Terzaghi, B. E. & Sandine, W. E. Improved medium for lactic streptococci and their bacteriophages. Appl. Microbiol. 29, 807-13 (1975).

Westerfeld, W. W. A colorimetric determination of paraldehyde. J. Lab. Clin. Med. 30, 1076 (1945).

Han, S.-H., Lee, J.-E., Park, K., Park, Y.-C. Production of 2,3-butanediol by a low-acid producing Klebsiella oxytoca NBRF4. New Biotechnology 30,166-172 (2013).

Goupil, N., Corthier, G., Ehrlich, S. D., Renault, P. Imbalance of leucine flux in Lactococcus lactis and its use for the isolation of diacetyl-overproducing strains. Appl. Environ. Microbiol. 62, 2636-2640 (1996).

Zhang X, et al. Mutation breeding of acetoin high producing Bacillus subtilis blocked in 2,3-butanediol dehydrogenase. World. J. Mirobiolol. Biotechnol. 29, 1783-9 (2013).

SEQUENCE LISTING (216 sequences)

SEQ ID NO: 1 - DNA, 978 bp, Lactococcus lactis
  CDS (1)..(978): Lactococcus lactis subsp. cremoris MG1363 ldh gene encoding lactate dehydrogenase
atggctgataaacaacgtaagaaagttatccttgttggtgacggtgctgtaggttcatcatacgcttttgcccttgttaaccaaggaattgcacaagaattaggtattgttgacctttttaaagaaaaaactcaaggggatgcagaagacctttctcatgccttggcatttacatcacctaaaaagatttactctgcagactactctgatgcaagcgacgctgacctcgttgtcttgacttctggtgctccacaaaaaccaggtgaaactcgtcttgaccttgttgaaaaaaatcttcgtattactaaagatgttgtaactaaaattgttgcttcaggattcaaaggaatcttcctcgttgctgctaacccagttgacatcttgacatacgcaacttggaaattctctggtttccctaaaaaccgtgttgtaggttcaggtacttcacttgatactgcacgtttccgtcaagcattggctgaaaaagttgacgttgatgctcgttcaatccacgcatacatcatgggtgaacacggtgactcagaatttgctgtttggtcacacgctaacgttgctggtgttaaattggaacaatggttccaagaaaatgactaccttaacgaagcagaaatcgttgaattgtttgagtctgtacgtgatgcagcttactcaatcatcgctaaaaaaggtgcaacattctacggtgtggctgtagcccttgctcgtattactaaagcaattcttgatgatgaacatgcagtacttcctgtatcagtattccaagatggacaatatggggtaagcgactgctaccttggtcaaccagctgtagttggtgctgaaggtgttgttaacccaattcacattccattgaacgatgctgaaatgcaaaaaatggaagcttctggagctcaattgaaagctatcatcgatgaagcttttgctaaagaagaatttgcttctgcagttaaaaactaa

SEQ ID NO: 2 - protein, 325 aa, Lactococcus lactis
MADKQRKKVILVGDGAVGSSYAFALVNQGIAQELGIVDLFKEKTQGDAEDLSHALAFTSPKKIYSADYSDASDADLVVLTSGAPQKPGETRLDLVEKNLRITKDVVTKIVASGFKGIFLVAANPVDILTYATWKFSGFPKNRVVGSGTSLDTARFRQALAEKVDVDARSIHAYIMGEHGDSEFAVWSHANVAGVKLEQWFQENDYLNEAEIVELFESVRDAAYSIIAKKGATFYGVAVALARITKAILDDEHAVLPVSVFQDGQYGVSDCYLGQPAVVGAEGVVNPIHIPLNDAEMQKMEASGAQLKAIIDEAFAKEEFASAVKN

SEQ ID NO: 3 - DNA, 972 bp, Lactobacillus acidophilus
  CDS (1)..(972): Lactobacillus acidophilus-NCFM LBA0271 gene encoding lactate dehydrogenase
atggcaagagttgaaaaacctcgtaaagttattttagttggtgacggtgctgtaggttctacctttgcattttcaatggtgcaacaaggtattgctgaagaattaggtatcattgatattgctaaggaacacgttgaaggtgacgcaatcgacttagcagatgctactccatggactttcccaaagaacatttacgcagctgactacgctgactgcaaggacgcagacttagtagttattactgctggtgctccacaaaagccaggtgaaactcgtcttgaccttgttaacaagaacttgaagattttatcatcaatcgttgaaccagttgttgaatcaggctttgaaggtatcttcttagtagttgctaacccagttgacatcttgactcacgcaacttggaagatttcaggcttccctaaggatcgcgttattggttcaggtacttcacttgatactggtcgtcttcaaaaggttatcggtaagatggaacacgttgacccacgttcagttaatgcatacatgcttggtgaacacggtgatactgaattcccagtatggagctacaacaatgttggtggcgtaaaggttagcgactgggttaaggctcacggtatggatgaatctaagcttgaagaaatccacaaggaagttgctgacatggcttacgacattatcaacaagaagggtgctactttctacggtatcggtacagcttcagcaatgatcgctaaggctatcttgaacgatgaacaccgtgtacttccactctcagttgcaatggatggtcaatacggtttacacgaccttcacattggtactcctgcagttgttggccgtaacggtcttgaacaaattattgaaatgcctttaaccgctgatgaacaagctaagatggaagcttctgctaagcaattaaaggaagttatggacaaagcctttgaagaaactggcgttaaggttcgtcaataa

SEQ ID NO: 4 - protein, 323 aa, Lactobacillus acidophilus
MARVEKPRKVILVGDGAVGSTFAFSMVQQGIAEELGIIDIAKEHVEGDAIDLADATPWTFPKNIYAADYADCKDADLVVITAGAPQKPGETRLDLVNKNLKILSSIVEPVVESGFEGIFLVVANPVDILTHATWKISGFPKDRVIGSGTSLDTGRLQKVIGKMEHVDPRSVNAYMLGEHGDTEFPVWSYNNVGGVKVSDWVKAHGMDESKLEEIHKEVADMAYDIINKKGATFYGIGTASAMIAKAILNDEHRVLPLSVAMDGQYGLHDLHIGTPAVVGRNGLEQIIEMPLTADEQAKMEASAKQLKEVMDKAFEETGVKVRQ

SEQ ID NO: 5 - DNA, 915 bp, Lactobacillus acidophilus
  CDS (1)..(915): Lactobacillus acidophilus-NCFM LBA1516 gene encoding lactate dehydrogenase
atgagaaaagtaggtataatcggaatgggtcatgtaggtgctactgtagcatatactttgtttactcatggaattgctgacgaattagttttaattgataaaaatgaagataaagttgctgctgaatataatgacttacgtgattctttatcaagaaataattactacgttcgtgtaactatgcaagattggcatgaattaaaagatgcggatattattgtaactgcttttggtgatattgcggctagtgtcaagactggcgatcgttttggtgaatttgaacttaacgctaagaatgcaaaagaagtcggtgaaaagattaagaacactggttttaagggtgtacttcttaatatctctaatccatgtgatgctgttgcacaaatcttgcaagaaactactggattaagtaagaaccaagttttaggtactggtactttcttggatactgcaagaatgcaaagaattattggtgaaaagctaggtcaagatccaaaaaatgttgaaggttgggttttgggtgaacatggttcatcacaatttatcgcttggtccactgttcgtgttaacaacaagattgctattcaattatttagcgaaaatgaacaaagaaagttaaataaggtaccaaacaagaattcatttgtggttgcaaatggaaaaggctacactagttacgcaattgctacatgtgctgtaaggcttattcaagcaatcttttctgatgctcatttatatgctcctgtatcagtatacaatccagaatacaagacttatattggctatcctgcaattattggtcgtgatggaattgaacaagtgattgaattgaaacttacttcaaatgaacgtgaaaagcttcaagcagcagctgataagatcaaggaacacttggaacaactgaagaacaagtaa

SEQ ID NO: 6 - protein, 304 aa, Lactobacillus acidophilus
MRKVGIIGMGHVGATVAYTLFTHGIADELVLIDKNEDKVAAEYNDLRDSLSRNNYYVRVTMQDWHELKDADIIVTAFGDIAASVKTGDRFGEFELNAKNAKEVGEKIKNTGFKGVLLNISNPCDAVAQILQETTGLSKNQVLGTGTFLDTARMQRIIGEKLGQDPKNVEGWVLGEHGSSQFIAWSTVRVNNKIAIQLFSENEQRKLNKVPNKNSFVVANGKGYTSYAIATCAVRLIQAIFSDAHLYAPVSVYNPEYKTYIGYPAIIGRDGIEQVIELKLTSNEREKLQAAADKIKEHLEQLKNK

SEQ ID NO: 7 - DNA, 927 bp, Lactobacillus acidophilus
  CDS (1)..(927): Lactobacillus acidophilus-NCFM LBA0910 gene encoding lactate dehydrogenase
atgagtagaaaagtgtttcttgtaggtgatggtgctgttggttcaacttttgcaaatgacttattgcaaaatacaactgttgatgaattagcgatttttgatgttgctaaagatcgtccagttggtgattcaatggatttggaagatattactccatttacaggtcaaactaatattcatccagcagaatatagtgatgctaaagatgcagatgtgtgtgtaattactgctggtgttcctcgtaaacctggtgaaactagacttgacttagttaataagaatgtaaagattttaaagactattgttgatccggttgttgaatccggttttaagggtgtatttgttgtttcagctaacccggttgatattttaaccacattgactcaaaaaatatccggttttccaaaagatcgtgtaattggtactggtacttcacttgattcaatgcgtcttcgcgttgaattggcaaagaaacttaatgttccagtagctaaggttaactcaatggttcttggtgaacacggtgatactagttttgaaaactttgacgaatcaactgttgacaataagccacttcgcgattactcagaaatcaatgataatgttttaagtgaaattgagtcagacgtccgtaaaaagggtggaaagatcatcactaacaaaggagctacattctatggtgttgctatgatgcttactcaaattgttagtgctattttagataatcgttcaatttgtttgccattatcagccccaattaatggtgaatatggcattaagcatgatctttacttaggtactccaactataattaacggtaatggtattgaaaaagttattgaaactaaactttcagatgtagaaaaagctaagatgatcaattctgcagataagatgcaagaagttttatcaggtgttgaaatgtaa

SEQ ID NO: 8 - protein, 308 aa, Lactobacillus acidophilus
MSRKVFLVGDGAVGSTFANDLLQNTTVDELAIFDVAKDRPVGDSMDLEDITPFTGQTNIHPAEYSDAKDADVCVITAGVPRKPGETRLDLVNKNVKILKTIVDPVVESGFKGVFVVSANPVDILTTLTQKISGFPKDRVIGTGTSLDSMRLRVELAKKLNVPVAKVNSMVLGEHGDTSFENFDESTVDNKPLRDYSEINDNVLSEIESDVRKKGGKIITNKGATFYGVAMMLTQIVSAILDNRSICLPLSAPINGEYGIKHDLYLGTPTIINGNGIEKVIETKLSDVEKAKMINSADKMQEVLSGVEM

SEQ ID NO: 9 - DNA, 924 bp, Lactobacillus delbrueckii
  CDS (1)..(924): Lactobacillus delbrueckii subsp. bulgaricus ATCC 11842_ Ldb0120 gene encoding lactate dehydrogenase
atgagtagaaaagtcctgctggttggcgacggtgctgtcggttccaactttgccaacgatttattgcaaacaacgcgggtggatgaactggtcatctgcgacttgaataaagaccgggccgcgggcgactgcctggacctggaagacatgacctactttacgggccagaccaagctgagagctggtgactacagcgacgcggctgacgccgacgtggtagttatcacggccggcgtgccccgcaagccaggtgaaagccggcttgacctgatcaagaagaatgaagccatcttgcggagcatcgttgatccagtcgtagcttccggcttcagcggcatcttcgtcgtttccgccaacccggttgacatcttgaccactttgacccagaagctgtccggcttcccaaagaagcgggtcatcgggaccgggacttccctggactcagctagtttgcgggtagaactggccaagcggctgcaagtgccaattgaatcagtcaacgcctgggttctgggtgaacatggcgacagcagctttgagaacttctcaagtgccgtggtcaacggcaagcccttgcttgactatccgggcatgacagaagcagccttagatgagattgaagcccacgtccgggaaaagggcagcgagattatcgtcaaaaagggcgcaacctactatggcgtggccatgatgctggccaagatcgtgacggccattttggaaaacaacgacctggccctgcctctttccgcaccattgcacggggaatacgggatcaaggatgagatctacctgggcaccctggccatcatcaacggacaagggatcagccacgtactggaattgccgttaaatgacagcgaattggccaagatgcgggcctcagccgcgacgataaaggcaaccctggactctttaggataa

SEQ ID NO: 10 - protein, 307 aa, Lactobacillus delbrueckii
MSRKVLLVGDGAVGSNFANDLLQTTRVDELVICDLNKDRAAGDCLDLEDMTYFTGQTKLRAGDYSDAADADVVVITAGVPRKPGESRLDLIKKNEAILRSIVDPVVASGFSGIFVVSANPVDILTTLTQKLSGFPKKRVIGTGTSLDSASLRVELAKRLQVPIESVNAWVLGEHGDSSFENFSSAVVNGKPLLDYPGMTEAALDEIEAHVREKGSEIIVKKGATYYGVAMMLAKIVTAILENNDLALPLSAPLHGEYGIKDEIYLGTLAIINGQGISHVLELPLNDSELAKMRASAATIKATLDSLG

SEQ ID NO: 11 - DNA, 939 bp, Lactobacillus casei
  CDS (1)..(939): Lactobacillus casei ATCC 334, LSEI_0634 gene encoding lactate dehydrogenase
atgcggaacaacggcaatattattttaattggtgatggcgcgattggatcaagttatgcgttcaactgtctcaccaccggcgtcggccagagtcttggtattattgatgttaacgaaaaacgcgtgcaaggtgacgtcgaagatctttctgatgccctaccttacacgtcacagaagaatatttatgcggccagctatgaagattgcaaatatgccgatattatcgtcatcacagccggaattgcccaaaagccaggtcagacacgcctacaacttttggccatcaacgcaaagatcatgaaagaaatcacacataacattatggcaagcgggttcaatgggtttattttagtcgcatccaatccagtcgatgtccttgccgaattagtcttgcaagaatccggcttgccacgtaatcaggtgctgggatcagggacggcgcttgattcagctcgcttacggtctgagatcggtctgcgttataacgtggacgcccggattgtgcacggctacatcatgggtgaacacggcgattctgaatttccagtttgggactacaccaacattggcggcaaaccgattcttgattggattcctaaagatcgccaggataaagatctgcctgatattagcgagcgcgtcaaaacggctgcttatggcatcattgagaaaaaaggtgccactttctacggcattgctgcctcattaacccgtttaaccagcgccttcttgaatgatgatcgcgcagcattcgcaatgtccgtccatttggaaggcgaatacggcttgtcaggtgtttccatcggtgtaccggtaatcctcggcgctaatggcttagaacgcatcattgagctggatttgaacccagaagatcataagcggttagccgattctgcagctattttgaaagaaaatctgaagaaggctcaagaagcttaa

SEQ ID NO: 12 - protein, 312 aa, Lactobacillus casei
MRNNGNIILIGDGAIGSSYAFNCLTTGVGQSLGIIDVNEKRVQGDVEDLSDALPYTSQKNIYAASYEDCKYADIIVITAGIAQKPGQTRLQLLAINAKIMKEITHNIMASGFNGFILVASNPVDVLAELVLQESGLPRNQVLGSGTALDSARLRSEIGLRYNVDARIVHGYIMGEHGDSEFPVWDYTNIGGKPILDWIPKDRQDKDLPDISERVKTAAYGIIEKKGATFYGIAASLTRLTSAFLNDDRAAFAMSVHLEGEYGLSGVSIGVPVILGANGLERIIELDLNPEDHKRLADSAAILKENLKKAQEA

SEQ ID NO: 13 - DNA, 981 bp, Lactobacillus casei
  CDS (1)..(981): Lactobacillus casei ATCC 334 _ gene LSEI_2549 encoding a lacate dehydrogenase
  tRNA (1)..(3): Met is inserted by tRNA at start codon (GTG) instead of Val
gtggcaagtattacggataaggatcaccaaaaagttattctcgttggtgacggcgccgttggttcaagttatgcctacgcaatggttttgcaaggtatcgctcaggaaatcggaatcgttgacattttcaaggacaagacaaagggtgacgcgattgacttgagcaacgcgctcccattcacaagtcctaagaagatttattcagctgaatacagcgatgctaaggatgctgatctggttgttatcacagctggcgctcctcagaagcctggcgaaactcgtttggacttggttaacaagaacttgaagatcttgaagtccattgttgacccaatcgttgattccggctttaacggtattttcttagttgctgccaacccagttgacattttgacctatgcaacttggaaactttctggcttcccgaagaaccgggttgttggttccggtacttcactggacaccgcccgcttccgtcagtccattgctgaaatggttaatgttgacgctcgttcggtccacgcttacatcatgggcgaacatggtgacactgaattccctgtatggtcccacgctaacattggtggcgttaccatcgctgaatgggttaaggctcatccagaaatcaaggaagacaagcttgttaagatgtttgaagacgttcgtgacgccgcttatgaaatcatcaaactcaagggtgcgaccttctatggtatcgcaactgcccttgcccggatttcaaaggcaatccttaacgacgaaaatgcggttctgccactttccgtttacatggatggtcaatatggcttgaacgacatctacatcggtactccagctgtgatcaaccgtaatggtatccagaacatcctggaaatcccattgaccgatcacgaagaagaatccatgcagaaatctgcttctcaattgaagaaggttctgaccgatgctttcgctaagaatgacatcgaaactcgtcagtaa

SEQ ID NO: 14 - protein, 326 aa, Lactobacillus casei
VASITDKDHQKVILVGDGAVGSSYAYAMVLQGIAQEIGIVDIFKDKTKGDAIDLSNALPFTSPKKIYSAEYSDAKDADLVVITAGAPQKPGETRLDLVNKNLKILKSIVDPIVDSGFNGIFLVAANPVDILTYATWKLSGFPKNRVVGSGTSLDTARFRQSIAEMVNVDARSVHAYIMGEHGDTEFPVWSHANIGGVTIAEWVKAHPEIKEDKLVKMFEDVRDAAYEIIKLKGATFYGIATALARISKAILNDENAVLPLSVYMDGQYGLNDIYIGTPAVINRNGIQNILEIPLTDHEEESMQKSASQLKKVLTDAFAKNDIETRQ

SEQ ID NO: 15 - DNA, 906 bp, Lactobacillus casei
  CDS (1)..(906): Lactobacillus casei ATCC 334_gene LSEI_2607 encoding lactate dehydrogenase
atggcaagaacaattggtattattggtattggacacgtaggtgtgaccacggcttttaatcttgtcagcaaaggggttgctgacaagttagtcttgattgataaaaaggctgaacttgctgaaggcgaaagctttgacttgaaggatgcgcttggcggcttgcccacttatactgacattgttgtcaacgattatgatgctttgaaagatgctgatgtggttatttccgcggtcggcaatattggcgccatttcaaatggtgatcgaattggagaaaccaagacttcaaaagtagcactagatgacgtcgctccaaaactgaaggcgtctggcttccatggcgttttgctagatatcaccaatccatgtgatgctgtcacgagttactggcaatatctcctagatttaccgaagtctcaaattattgggactgggacttcgctggatacttatcggatgcgacgggcggttgccgataccttgcatgtgaatgttgctgacgtgcgtggttacaatatgggcgaacatggcgaatcgcaatttaccgcttggtcaacagtacgggtcaataatgaaccgattgctgaatatgcgaaggttgattacgaccagcttgccgatgatgcgcgggcaggcggttggaagatttatcaggctaagcattatacgagctacggtatcgccaccatcgcgactgaaatgacacaggcgatcatcagcgatgcacatcgcatcttcccatgcgctaattacgatccagaattcggtattgctatcggtcatccagccatgatcggtaaacaaggtgttatcaagacgccaacgttgaagttgacagatgaagagcgtgctaagtatgttcactctgccggtatcattaaggatacctttgaaaaaatgaagtag

SEQ ID NO: 16 - protein, 301 aa, Lactobacillus casei
MARTIGIIGIGHVGVTTAFNLVSKGVADKLVLIDKKAELAEGESFDLKDALGGLPTYTDIVVNDYDALKDADVVISAVGNIGAISNGDRIGETKTSKVALDDVAPKLKASGFHGVLLDITNPCDAVTSYWQYLLDLPKSQIIGTGTSLDTYRMRRAVADTLHVNVADVRGYNMGEHGESQFTAWSTVRVNNEPIAEYAKVDYDQLADDARAGGWKIYQAKHYTSYGIATIATEMTQAIISDAHRIFPCANYDPEFGIAIGHPAMIGKQGVIKTPTLKLTDEERAKYVHSAGIIKDTFEKMK

SEQ ID NO: 17 - DNA, 963 bp, Lactobacillus plantarum
  CDS (1)..(963): Lactobacillus plantarum WCFS1_ gene lp_0537 encoding lactate dehydrogenase
  tRNA (1)..(3): Met is inserted by tRNA at start codon (TTG) instead of Leu
ttgtcaagcatgccaaatcatcaaaaagttgtgttagtcggcgacggcgctgttggttctagttacgcttttgccatggcacaacaaggaattgctgaagaatttgtaattgtcgatgttgttaaagatcggacaaagggtgacgcccttgatcttgaagacgcccaagcattcaccgctcccaagaagatttactcaggcgaatattcagattgtaaggacgctgacttagttgttattacagccggtgcgcctcaaaagcctggtgaatcacgtttagacttagttaacaagaatttaaatatcctatcatccattgtcaaaccagttgttgactccggctttgacggcatcttcttagttgctgctaaccctgttgacatcttaacttacgctacttggaaattctcaggtttcccaaaggatcgtgtcattggttcagggacttccttagactcttcacgtttacgcgttgcgttaggcaaacaattcaatgttgatcctcgttccgttgatgcttacatcatgggtgaacacggtgattctgaatttgctgcttactcaactgcaaccatcgggacacgtccagttcgcgatgtcgctaaggaacaaggcgtttctgacgaagatttagccaagttagaagacggtgttcgtaacaaagcttacgacatcatcaacttgaagggtgccacgttctacggtatcgggactgctttaatgcggatttccaaagccattttacgtgatgaaaatgccgttttaccagtaggtgcctacatggacggccaatacggcttaaacgacatttatatcgggactccggctgtgattggtggaactggtttgaaacaaatcatcgaatcaccactttcagctgacgaactcaagaagatgcaagattccgccgcaactttgaaaaaagtgcttaacgacggtttagctgaattagaaaataaataa

SEQ ID NO: 18 - protein, 320 aa, Lactobacillus plantarum
LSSMPNHQKVVLVGDGAVGSSYAFAMAQQGIAEEFVIVDVVKDRTKGDALDLEDAQAFTAPKKIYSGEYSDCKDADLVVITAGAPQKPGESRLDLVNKNLNILSSIVKPVVDSGFDGIFLVAANPVDILTYATWKFSGFPKDRVIGSGTSLDSSRLRVALGKQFNVDPRSVDAYIMGEHGDSEFAAYSTATIGTRPVRDVAKEQGVSDEDLAKLEDGVRNKAYDIINLKGATFYGIGTALMRISKAILRDENAVLPVGAYMDGQYGLNDIYIGTPAVIGGTGLKQIIESPLSADELKKMQDSAATLKKVLNDGLAELENK

SEQ ID NO: 19 - DNA, 930 bp, Lactobacillus plantarum
  CDS (1)..(930): Lactobacillus plantarum WCFS1; gene lp_1101 encoding lactate dehydrogenase
atggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcgtgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcagttgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaaccgcaacgggctccaaaaagtgatcgaagctgagctatcagatgatgagcgtgcccggatgcaacatttcgcagccaagatgctgaccatgatgaatgtggcatcataa

SEQ ID NO: 20 - protein, 309 aa, Lactobacillus plantarum
MDKKQRKVVIVGDGSVGSSFAFSLVQNCALDELVIVDLVKTHAEGDVKDLEDVAAFTNATNIHTGEYADARDADIVVITAGVPRKPGESRLDLINRNTKILESIVKPVVASGFNGCFVISSNPVDILTSMTQRLSGFPRHRVIGTGTSLDTARLRVALAQKLNVATTAVDAAVLGEHGDSSIVNFDEIMINAQPLKTVTTVDDQFKAEIEQAVRGKGGQIISQKGATFYGVAVSLMQICRAILNDENAELIVSAALSGQYGINDLYLGSPAIINRNGLQKVIEAELSDDERARMQHFAAKMLTMMNVAS

SEQ ID NO: 21 - DNA, 963 bp, Pediococcus pentosaceus
  CDS (1)..(963): Pediococcus pentosaceus ATCC 25745: gene PEPE_1554 encoding lactate dehydrogenase
  tRNA (1)..(3): Met is inserted by tRNA at start codon (TTG) instead of Leu
ttgtctaaaattcaaaaccatcaaaaagttgtattagtcggcgacggcgctgtaggttcaagttatgcctttgcaatggcacaacaaggaattgcagaagaattcgtaatcgttgatgttgttaaggaccgtactgttggtgacgcacttgatcttgaagatgctactccatttactgcacctaagaacatttactcaggtgaatattctgactgtaaagatgcagatcttgtagttatcactgctggtgctccacaaaaaccaggtgaaacacgtcttgaccttgttaacaagaacttaaacattctttcaacaatcgttaagccagttgttgactcaggcttcgacggtatcttcttagttgctgctaacccagttgatatccttacttacgcaacatggaaattctcaggattccctaaagaaaaggttatcggttcaggtatttctcttgattcagcacgtctacgtgttgctcttggtaagaaattcaacgttagccctgactcagttgatgcatacatcatgggtgaacatggtgacagtgaattcgctgcttactcaactgcttcaatcggtacaaagccattgcttgatatcgctaaagaagaaggcgtttcaactgacgaattagctgaaatcgaagacagtgttcgtaacaaagcttacgaaatcatcaacaagaagggtgctacattctacggtgttggtactgctttgatgcgtatttcaaaagctatcttgcgtgacgaaaatgctgtattgcctgttggtgcttacatggacggcgaatatggtttgaatgacatctacatcggtacacctgctgttattaacggccaaggtttgaaccgtgttatcgaatcaccacttagtgatgacgaaatgaagaagatgacagattcagctacaacattgaaaaaagttcttacagatggtttgaaagctcttgaagaaaaataa

SEQ ID NO: 22 - protein, 320 aa, Pediococcus pentosaceus
LSKIQNHQKVVLVGDGAVGSSYAFAMAQQGIAEEFVIVDVVKDRTVGDALDLEDATPFTAPKNIYSGEYSDCKDADLVVITAGAPQKPGETRLDLVNKNLNILSTIVKPVVDSGFDGIFLVAANPVDILTYATWKFSGFPKEKVIGSGISLDSARLRVALGKKFNVSPDSVDAYIMGEHGDSEFAAYSTASIGTKPLLDIAKEEGVSTDELAEIEDSVRNKAYEIINKKGATFYGVGTALMRISKAILRDENAVLPVGAYMDGEYGLNDIYIGTPAVINGQGLNRVIESPLSDDEMKKMTDSATTLKKVLTDGLKALEEK

SEQ ID NO: 23 - DNA, 996 bp, Leuconostoc mesenteroides
  CDS (1)..(996): Leuconostoc mesenteroides subsp. mesenteroides ATCC 8293: gene LEUM_1756 encoding lactate dehydrogenase
atgaagatttttgcttacggcattcgtgatgatgaaaagccatcacttgaagaatggaaagcggctaacccagagattgaagtggactacacacaagaattattgacacctgaaacagctaagttggctgagggatcagattcagctgttgtttatcaacaattggactatacacgtgaaacattgacagctttagctaacgttggtgttactaacttgtcattgcgtaacgttggtacagataacattgattttgatgcagcacgtgaatttaactttaacatttcaaatgttcctgtttattcaccaaatgctattgcagaacactcaatgattcaattatctcgtttgctacgtcgcacgaaagcattggatgccaaaattgctaagcacgacttgcgttgggcaccaacaattggacgtgaaatgcgtatgcaaacagttggtgttattggtacaggtcatattggccgtgttgctattaacattttgaaaggctttggggccaaggttattgcttatgacaagtacccaaatgctgaattacaagcagaaggtttgtacgttgacacattagacgaattatatgcacaagctgatgcaatttcattgtatgttcctggtgtacctgaaaaccatcatctaatcaatgcagatgctattgctaagatgaaggatggtgtggttatcatgaacgctgcgcgtggtaatttgatggacattgacgctattattgatggtttgaattctggtaagatttcagacttcggtatggacgtttatgaaaatgaagttggcttgttcaatgaagattggtctggtaaagaattcccagatgctaagattgctgacttgattgcacgcgaaaatgtattggttacgccacacacggctttctatacaactaaagctgttctagaaatggttcaccaatcatttgatgcagcagttgctttcgccaagggtgagaagccagctattgctgttgaatattaa

SEQ ID NO: 24 - protein, 331 aa, Leuconostoc mesenteroides
MKIFAYGIRDDEKPSLEEWKAANPEIEVDYTQELLTPETAKLAEGSDSAVVYQQLDYTRETLTALANVGVTNLSLRNVGTDNIDFDAAREFNFNISNVPVYSPNAIAEHSMIQLSRLLRRTKALDAKIAKHDLRWAPTIGREMRMQTVGVIGTGHIGRVAINILKGFGAKVIAYDKYPNAELQAEGLYVDTLDELYAQADAISLYVPGVPENHHLINADAIAKMKDGVVIMNAARGNLMDIDAIIDGLNSGKISDFGMDVYENEVGLFNEDWSGKEFPDAKIADLIARENVLVTPHTAFYTTKAVLEMVHQSFDAAVAFAKGEKPAIAVEY

SEQ ID NO: 25 - DNA, 990 bp, Leuconostoc mesenteroides
  CDS (1)..(990): Leuconostoc mesenteroides subsp. mesenteroides ATCC 8293: gene LEUM_2043 encoding lactate dehydrogenase
atgaaaattttaatgtacaatacagtttcagacgaaatgccatatgttgaaaaatggactgaaaaaacaggccacgaagtagtgaccattgatcaaccacttaacgaaacgacggtggatcgcgctaaaggttttgatgcaattaccacacaacaaacaacagccattaatgcaccagtttatgcgcaactagctcaattcaatattaagcaaatcgctattcgacaggttggctatgatgtgttggacttgccagaagcctttgctcacaatattcgtttgtctaatgttgcagcctattcaccccgagcaattgcagaatacacgctaacacagctttttaatttaattcgacacaataaaaagtttgatcgcgccatgaatacgggtgactatacttgggctgctggtggtcaagcgagagaaattcatgatttaactgttgctgtgattggtgtaggtcgaattgggacagcccttgcagaaatgcttcacgcgctgggcgcaacagtgttaggtgtggacccaatatatcgtgcccagaacgaaccatttgtaacttatacgacattagatgatgctttgtctcgagcggatgttattagttttcatacaccattaaatgacgagacgcgctatatggctgatgaaaatttctttgctaaaattcagccaggaacaattatgttgaattttgcgcgtggtgaaattgttgacatggttgagcttgaaaaagcactcgaatcaaagttattggctggtgcagcatttgatgtgacaccaaatgaaaatgattttatgaaccaaaagcaagatataacggcgctaccagcagatgtaaagcgcttaatcgaatatgacaactttctactgtcaccacatattgctttttatacaaacacagcaataaaaaatatggtggaaatggctttaaatgatgccgtaacgatggtaaatggcggcgttactgaaaacgaaattttgcggtaa

SEQ ID NO: 26 - protein, 329 aa, Leuconostoc mesenteroides
MKILMYNTVSDEMPYVEKWTEKTGHEVVTIDQPLNETTVDRAKGFDAITTQQTTAINAPVYAQLAQFNIKQIAIRQVGYDVLDLPEAFAHNIRLSNVAAYSPRAIAEYTLTQLFNLIRHNKKFDRAMNTGDYTWAAGGQAREIHDLTVAVIGVGRIGTALAEMLHALGATVLGVDPIYRAQNEPFVTYTTLDDALSRADVISFHTPLNDETRYMADENFFAKIQPGTIMLNFARGEIVDMVELEKALESKLLAGAAFDVTPNENDFMNQKQDITALPADVKRLIEYDNFLLSPHIAFYTNTAIKNMVEMALNDAVTMVNGGVTENEILR

SEQ ID NO: 27 - DNA, 987 bp, Streptococcus thermophilus
  CDS (1)..(987): Streptococcus thermophilus CNRZ1066: gene str1280 encoding lactate dehydrogenase
atgactgcaactaaactacacaaaaaagtcatccttgttggtgacggtgccgtaggttcatcttacgctttcgcacttgtaaaccaaggtatcgctcaagaactaggtatcatcgaaattccacaattatttgaaaaagccgttggtgatgcgcttgaccttagccacgcacttcctttcacttcacctaaaaaaatctatgcagctaaatatgaagactgtgcggatgctgaccttgtagttatcactgctggtgctcctcaaaaaccaggtgagactcgtcttgatcttgttggtaaaaaccttgcaatcaacaaatcaatcgttactcaagttgttgaatcaggattcaacggtattttccttgtagctgctaacccagtagacgtattgacttactctacatggaagttctcaggattccctaaagaacgcgttatcggttcaggtacttcacttgactcagctcgtttccgtcaagcacttgctgaaaaacttaatgtcgatgctcgttcagttcacgcttacatcatgggtgaacacggcgactcagagtttgcggtttggtcacacgctaacatcgccggtgtaaaccttgaagagttccttaaagacaaagaaaacgttcaagaagctgaattagttgaattgttcgaaggtgttcgtgatgcagcttacacaattatcaacaaaaaaggtgctacatactacggtatcgcagtagcccttgctcgtatcactaaagctatccttgacgatgaaaatgcagtacttccattgtctgtattccaagaaggtcaatatggtgtaaacaacatctttatcggtcaacctgccattgtaggtgcacacggtatcgtacgtccagtaaacatcccattgaacgatgctgaacaacaaaagatgaaggcttctgccgatgaattgcaagctatcattgatgaagcatggaaaaaccctgaattccaagaagcttcaaaaaactaa

SEQ ID NO: 28 - protein, 328 aa, Streptococcus thermophilus
MTATKLHKKVILVGDGAVGSSYAFALVNQGIAQELGIIEIPQLFEKAVGDALDLSHALPFTSPKKIYAAKYEDCADADLVVITAGAPQKPGETRLDLVGKNLAINKSIVTQVVESGFNGIFLVAANPVDVLTYSTWKFSGFPKERVIGSGTSLDSARFRQALAEKLNVDARSVHAYIMGEHGDSEFAVWSHANIAGVNLEEFLKDKENVQEAELVELFEGVRDAAYTIINKKGATYYGIAVALARITKAILDDENAVLPLSVFQEGQYGVNNIFIGQPAIVGAHGIVRPVNIPLNDAEQQKMKASADELQAIIDEAWKNPEFQEASKN

SEQ ID NO: 29 - DNA, 960 bp, Oenococcus oeni
  CDS (1)..(960): Oenococcus oeni PSU-1: gene OEOE_0025 encoding lactate dehydrogenase
atgaaaaatgttctcatcacagcggagcttcctcaagttgcaaatagtatacttcaacaagccggcctaaatgtcgaaatttttacgggtgataaattaattacaaagaaggaattacttgataaagtcaaagataaagattttttaattacctctctatcaacagatgttgatgaagacgtaataaatgcagctccaaaattaaaattaattgcgaactttggagccggattcaataacatcgacataaatagtgctcgagcaaaagaaatatctgttacaaacactccttttgtctcgactacttcagtagccgaggtcacagcaggactaattatttccctatcgcatcgtttggttgaaggagataatttaatgcacgatcaaggattcaatggctggagtcccttattctttttaggccatgaactatctaaaaaaacattagggatcatcggcatgggtcagattggcaaggctttggccaaacgtatgcaggactttgatatgaaaattgtttacacacaaaggcatcacttaaaagaagatgaggaaaaagaacttcatgctgttttcttggaaaaagacgaattaattaaacaaagcgatgtaattagcttgcatttgccactaacgaaaaatacccatcacttgttgggtgctaaagaatttgcaactatgaaaaaaacttctttcctaattaacgctgctcgtggaccgttaattgacgaaaatgcattgctacagtccctaaaagaaaagcagcttgctggagctgctttagatgtttatgaacatgaaccaaaagttgatgatcaatttaaacagatgaaaaatgttattctgactccccatatcggcaatgcaaccatcgaagcccgtaatgcaatggctgaagtcgtcgccaaaaatgtggtatcagtgttaaatggtgaaaaaccgaaatatatcgttaattaa

SEQ ID NO: 30 - protein, 319 aa, Oenococcus oeni
MKNVLITAELPQVANSILQQAGLNVEIFTGDKLITKKELLDKVKDKDFLITSLSTDVDEDVINAAPKLKLIANFGAGFNNIDINSARAKEISVTNTPFVSTTSVAEVTAGLIISLSHRLVEGDNLMHDQGFNGWSPLFFLGHELSKKTLGIIGMGQIGKALAKRMQDFDMKIVYTQRHHLKEDEEKELHAVFLEKDELIKQSDVISLHLPLTKNTHHLLGAKEFATMKKTSFLINAARGPLIDENALLQSLKEKQLAGAALDVYEHEPKVDDQFKQMKNVILTPHIGNATIEARNAMAEVVAKNVVSVLNGEKPKYIVN

SEQ ID NO: 31 - DNA, 978 bp, Oenococcus oeni
  CDS (1)..(975): Oenococcus oeni PSU-1: gene OEOE_1709 encoding lactate dehydrogenase
atgtatgctgttttcgaagatgaagtaccttatattgaagagtttgccaatcgtactggccatgaaatcgttcaggaaaccgattatttatccgaaaaaaatgtcgatttggcagccggtttcgatgcggttgttacccaacagacggtcaacattcctgacatggtgtattctcgtctggctgaattaggtatcaggcaaatcagtatccgtcaggttggttacgatattttaaatatcgatgcgattgataaagccggactgcgtgcgtcaaatgtcgcagcttattcgccaagagcgattgccgaatacacattgacacaacttttaaacctgatccgtgacaacaagagatattatcaggccacagaatcgggtaattggttatggtctgcagcccctcaggggaaagaaatccatgatctaacggtcgctgttatcggcgctggacgtattggttcggctctggctgagatgcttcatgtacttggcgcgaaggttttggcagttgatccggtttaccatgctcaaaatgaagcttttttggattatacaaatcttgacgatgctttgaaaagggctgatgttatcactttccatacgcctttaaacaagcagaccaatggtatggccgacaaagatttttttcaaaaagttaaaaagaatgcatacattttaaactttgcccgcggagggattattcaaacttcggctttattggaaaatttgcgtagcggaaaattagctggagcagctctggatgttttgcccaatgaaaccgagtttatgggcaaaatccaaaatcctgacaaacttccggctgatgttcaggaattaatgtcgagggacaacgttttactgtcgccacacgtggctttttatacgaacctggccgttaaaaatatggttgaaatagctttaaacgatgcgattgccctttctcaaggcaaacatatcgagaatgaaattctttattaa

SEQ ID NO: 32 - protein, 325 aa, Oenococcus oeni
MYAVFEDEVPYIEEFANRTGHEIVQETDYLSEKNVDLAAGFDAVVTQQTVNIPDMVYSRLAELGIRQISIRQVGYDILNIDAIDKAGLRASNVAAYSPRAIAEYTLTQLLNLIRDNKRYYQATESGNWLWSAAPQGKEIHDLTVAVIGAGRIGSALAEMLHVLGAKVLAVDPVYHAQNEAFLDYTNLDDALKRADVITFHTPLNKQTNGMADKDFFQKVKKNAYILNFARGGIIQTSALLENLRSGKLAGAALDVLPNETEFMGKIQNPDKLPADVQELMSRDNVLLSPHVAFYTNLAVKNMVEIALNDAIALSQGKHIENEILY

SEQ ID NO: 33 - DNA, 939 bp, Bacillus coagulans
  CDS (1)..(939): Bacillus coagulans 36D1: gene Bcoa_0653 encoding lactate dehydrogenase
atgaaaaaggtcaatcgtattgcagtggttggaacgggtgcagttggtacaagttactgctacgccatgattaatcagggtgttgcagaagagcttgttttaatcgatattaacgaagcaaaagcagaaggggaagccatggacctgaaccacggcctgccatttgcgcctacgccgacccgcgtttggaaaggcgattattccgattgcggcactgccgatcttgttgtcattacggcaggttccccgcaaaaaccgggcgaaacaaggcttgatcttgttgccaaaaacgcaaaaatttttaaaggcatgattaagagcatcatggacagcggctttaacgggatttttcttgttgccagcaacccggttgacattttgacatatgtaacttggaaagagtccggcctgccgaaagaacatgttatcggttcgggcacagtgcttgactccgcgcgtctccgcaactctttaagcgcccacttcggaattgacccgcgcaatgtccatgccgcaattatcggcgaacacggcgacacggaacttccggtttggagccatacaacgatcggttatgacaccattgaaagctatctgcaaaagggaaccattgaccaaaaaacattagatgatatttttgtcaacacgagagatgcggcttaccatatcattgaacgaaaaggggccacattttacggcatcgggatgtctctgacccggatcacaagagcgatcctgaacaatgaaaacagtgttttgacagtctctgcctttttggaaggccagtacggaaacagcgatgtgtacattggtgttcctgccgttattaaccgccaaggcgtccgtgaagtggttgaaatcgagctgaacgacaaagaacaggaacaatttagccattctgttaaagtattaaaagaaacgatggcacctgtattgtaa

SEQ ID NO: 34 - protein, 312 aa, Bacillus coagulans
MKKVNRIAVVGTGAVGTSYCYAMINQGVAEELVLIDINEAKAEGEAMDLNHGLPFAPTPTRVWKGDYSDCGTADLVVITAGSPQKPGETRLDLVAKNAKIFKGMIKSIMDSGFNGIFLVASNPVDILTYVTWKESGLPKEHVIGSGTVLDSARLRNSLSAHFGIDPRNVHAAIIGEHGDTELPVWSHTTIGYDTIESYLQKGTIDQKTLDDIFVNTRDAAYHIIERKGATFYGIGMSLTRITRAILNNENSVLTVSAFLEGQYGNSDVYIGVPAVINRQGVREVVEIELNDKEQEQFSHSVKVLKETMAPVL

SEQ ID NO: 35 - DNA, 984 bp, Bacillus coagulans
  CDS (1)..(984): Bacillus coagulans 36D1: gene Bcoa_3093 encoding lactate dehydrogenase
  tRNA (1)..(3): Met is inserted by tRNA at start codon (GTG) instead of Val
gtgaaaaagacaaaattagtagttgcaggcgttgggcatgtcggttcgtatgtgcttgcaaatgcgatgaaactgggccttttttcggaaattgctgtattggataaaaagaaaggggtcgcatttggggaagcgctcgattggagacatgccacggcacttacatatatgccaaacacaagcgtgaaagcaggggattactcggaatgcgccgatgcggacgtcattatttgtgcagcagggccaagcgtgcttccgtcggaaaaagacgaaatgccggaccgggcagggcttgccaggacgaatgccgccgtggtgcgggaagtcatggcagggattacgaaatatacaaaagaagctgtcatcattttcattacaaatccgcttgatacgattgtctatattgctgaaaatgaatttggctattcgaaagggcggatattcggaacaggcaccatgcttgactcggcccgcctccgccagcttgttgccgaaaattacagcattgatccgaaaagtgtaacgggttatatgatgggcgaacacgggtttaccgcatttccggttttcagtcgtttaaatgtacagggattccgtgaaaaagaactggacagcgtgtttaaaggaaaagaaccgttggacagggaagctttcagacaaaaggtggtgaaaactgcttttgatgtcctgaatgggaaagggtggaccaatgccggtgttgctgaagctgcagtgacattggcaaaagccgtgatgctggatgaaaaaagcatttatccggtttcagccactttgcatggtcagtacggatataacggtgatgtcgctttaagcataccaagtgtcatcggccgtaacgggatcgaacaacagcttgaaattgaactcgatgaacaggaaacatcctggctgcacgaatcggcaaaatcgatccaaaatacaatggcatcggtaaaaaccggaaaatcgtatattcaggcttga

SEQ ID NO: 36 - protein, 327 aa, Bacillus coagulans
VKKTKLVVAGVGHVGSYVLANAMKLGLFSEIAVLDKKKGVAFGEALDWRHATALTYMPNTSVKAGDYSECADADVIICAAGPSVLPSEKDEMPDRAGLARTNAAVVREVMAGITKYTKEAVIIFITNPLDTIVYIAENEFGYSKGRIFGTGTMLDSARLRQLVAENYSIDPKSVTGYMMGEHGFTAFPVFSRLNVQGFREKELDSVFKGKEPLDREAFRQKVVKTAFDVLNGKGWTNAGVAEAAVTLAKAVMLDEKSIYPVSATLHGQYGYNGDVALSIPSVIGRNGIEQQLEIELDEQETSWLHESAKSIQNTMASVKTGKSYIQA

SEQ ID NO: 37 - DNA, 972 bp, Lactococcus lactis
  CDS (1)..(972): Lactococcus lactis subsp. cremoris llmg_1429 (ldhX) gene encoding lactate dehydrogenase
atgaaaattaataataaaaaagttgtaattgtgggagctggagcagtagggagtacttatgctcataatttggtcgttgatgatttagcagatgaaatcgccattatcaatactaataaaagtaaggcttcagccaatagtttggacttacttcatgctctgccttatttaaactcagctcctaaaaatatttatgcagcagactacgctgatgttgctgacgccgatatcgttgttttatccgctaatgctccgtcagctacctttggtaaaaatccagaccgtcttcaattactagaaaataatgttgagatgattcgtgatatcacgcgaaaaacaatggacgctggctttgacggtattttcttagtagcttcaaaccccgtagacgtacttgctcaagtagttgctgaagtttctggcttacctaaacaccggattattggaacaggaaccttgcttgaaacaagtcgaatgcgacaaattgtagctgagaaacttcaaattaaccctaaaagtattcatggttatgttttagctgaacatgggaaatctagttttgccgcttggtccaatgttactgttggggcaattccattaacaacttggcttgaaaaatatccaaatccagattttccgacatttgatgaaattgatcaagaaattcgtgaagttggtttagatattttcatgcaaaaaggaaatacttcatacggaatcgcagcttcattagcacgtttaacaagagcaattttccgaaatgagagcgtcattttacctgtttcggctcatttgacaggtcagtatggacaagctgaactatatacaggtagtccagcaataatcgaccggacaggtgttcgagccgttttagaattggaattaacagcagaagagcaaggtaaatttgaacattctgcagcactcttaaaagagaactttgaatccatcaaggaaaaatgcacattataa

SEQ ID NO: 38 - protein, 323 aa, Lactococcus lactis
MKINNKKVVIVGAGAVGSTYAHNLVVDDLADEIAIINTNKSKASANSLDLLHALPYLNSAPKNIYAADYADVADADIVVLSANAPSATFGKNPDRLQLLENNVEMIRDITRKTMDAGFDGIFLVASNPVDVLAQVVAEVSGLPKHRIIGTGTLLETSRMRQIVAEKLQINPKSIHGYVLAEHGKSSFAAWSNVTVGAIPLTTWLEKYPNPDFPTFDEIDQEIREVGLDIFMQKGNTSYGIAASLARLTRAIFRNESVILPVSAHLTGQYGQAELYTGSPAIIDRTGVRAVLELELTAEEQGKFEHSAALLKENFESIKEKCTL

SEQ ID NO: 39 - DNA, 945 bp, Lactococcus lactis
  CDS (1)..(945): Lactococcus lactis subsp. cremoris llmg_0392 (ldhB) gene encoding lactate dehydrogenase
atgaaaattacaagtagaaaagtagtcgtgattggaacaggatttgtcggaacaagtattgcttattcaatgattaatcaagggcttgtcaacgagttagttttgatagatgtcaatcaagataaagctgagggtgaggctttagatttattggatggcatatcttgggctcaagaaaatgttattgtaagagctggaaattacaaggattgtgaaaatgcagatattgtcgtgattacagctggtgtgaaccaaaaacccggacaatcacgtttagatttggtcaatacaaatgctaaaattatgcgctcaatcgttactcaagttatggattcaggttttgatggtatttttgtaattgcttctaatcctgtggatatccttacctatgtcgcttgggaaacttctggtcttgaccaatctagaattgtcggaactggtacaactttggataccacacgttttagaaaagaattggccacaaaactagaaattgaccctcggagtgttcacggatatattattggtgagcatggcgattctgaagttgcagtttggtcacacactacgataggtggaaaacctattcttgaatttattgttaaaaataaaaaaattggtcttgaagatttgtctaatttgtcaaataaggttaaaaatgctgcttatgaaattattgataaaaaacaagccacttattacggaattggaatgagcacagctagaattgtcaaagccatattaaataatgaacaagtcattctaccagtttctgcctatttgcgtggagaatatggtcaagaaggggtctttactggtgttccatctgtcgtaaatcaaaatggtgtcagagaaattattgaactcaatattgatgcttatgaaatgaaacaatttgaaaagtctgtcagtcaacttaaagaagtcatagaatctattaaataa

SEQ ID NO: 40 - protein, 314 aa, Lactococcus lactis
MKITSRKVVVIGTGFVGTSIAYSMINQGLVNELVLIDVNQDKAEGEALDLLDGISWAQENVIVRAGNYKDCENADIVVITAGVNQKPGQSRLDLVNTNAKIMRSIVTQVMDSGFDGIFVIASNPVDILTYVAWETSGLDQSRIVGTGTTLDTTRFRKELATKLEIDPRSVHGYIIGEHGDSEVAVWSHTTIGGKPILEFIVKNKKIGLEDLSNLSNKVKNAAYEIIDKKQATYYGIGMSTARIVKAILNNEQVILPVSAYLRGEYGQEGVFTGVPSVVNQNGVREIIELNIDAYEMKQFEKSVSQLKEVIESIK

SEQ ID NO: 41 - DNA, 981 bp, Lactococcus lactis
  CDS (1)..(981): Lactococcus lactis subsp. cremoris MG1363: gene llmg_0763 encoding phosphotransacetylase
atggaactttttgaatcactgaaacaaaagattagtggaaaagacttaaaaattgtctttcctgaaggaactgatacacgtattttaggtgctgcaaatcgtcttaatgccgatggattgattacacctgtctttattggaaatgtcaaagaagtcactgaaacattgatttcacgtggaattaacccagagggctttgagatttacgacccagaaaattgtggacgttttgaaacaatgacagaaacatttgttgaacgtcgcaagggtaaagttacagaagaacaagcaaaagaaattttgaaagacccaaattactttggaacaatgcttgtttatatgggaattgctgacggaatggtttctggtgcaattcattcaactgctgatactgttcgtccggctctccaaatcattaaaacaaaaccaggagtaaaatctgtttctggtgcctttattatggttcgcggtcgtgatgacaatgaaaaatatatttttggtgactgtgcaattaacatcaaacctgatgctccaacacttgctgatatcgccgtagcctcagccgaaactgcaagactctttgatattgaccctaaaattgcgatgctttcattctcaactaaaggttctggtaaatcagaagatgtggataaagtggttgaagcaacaacactagttaaagaaggtcaccctgaagttgaaattgatggggaacttcaatttgatgctgcctttgttccagctgttgcacgtcaaaaagcacctgattcagaagttgctggtcgtgcaaacgtctttatcttcccagacattcaatcagggaatattggatacaaaattgcgcaacgtctaggtaattttgaagccattggcccaatcttacaaggattgaatgcgcctgtttctgacctttcacgcggttgtaacgaagaagatgtttataaacttgcaatcatcacagctgctcaagctttaaaataa

SEQ ID NO: 42 - protein, 326 aa, Lactococcus lactis
MELFESLKQKISGKDLKIVFPEGTDTRILGAANRLNADGLITPVFIGNVKEVTETLISRGINPEGFEIYDPENCGRFETMTETFVERRKGKVTEEQAKEILKDPNYFGTMLVYMGIADGMVSGAIHSTADTVRPALQIIKTKPGVKSVSGAFIMVRGRDDNEKYIFGDCAINIKPDAPTLADIAVASAETARLFDIDPKIAMLSFSTKGSGKSEDVDKVVEATTLVKEGHPEVEIDGELQFDAAFVPAVARQKAPDSEVAGRANVFIFPDIQSGNIGYKIAQRLGNFEAIGPILQGLNAPVSDLSRGCNEEDVYKLAIITAAQALK

SEQ ID NO: 43 - DNA, 990 bp, Lactobacillus acidophilus
  CDS (1)..(990): Lactobacillus acidophilus NCFM: gene LBA0704 encoding phosphotransacetylase
atgagcgtattttcattattcaaagaacaagttgaacaagctgatgaaaagaaaaaaattattttcccagaaagtaatgatcttagaatcttaactgcagtttccaatttaaataaggacaatattatcgatccaattttgattggtaaaagagaagatattgaaaaattggctgcagaaaataatttagatcttgatggtgtaaagatttatgatcaaaataattatgctggtttagatgaaatggctgaagcatttgttaaagctagaaaaaaggatactagtattgccgaagcaaaggctaagctagcaaaaggtaattactttggtactatgctagtaaagatgggaaaagctgatggaatggtatcaggtgctgcgcattcaactgctaatactgttttacctgctttacaattaattcatgctgctaaggggatgcatcgcgtatcgggtgctttcgtaatggaaaaaggcgatgaaagatatatttttgctgattgtgctattaatattgatccagatgaagaaactttggcagaaattggttatcaatccgctcaaactgctaaaatggcaggaatcgatcctaaggttgcatttttaagcttttcaactaaagggtcagctgaaggtcctatggtaaataaagttcatgacgctgctgcaatgttccaaaaagatcatccagaaatccctgcagatggtgaattacaatttgatgctgcatttgttccatcagttggtgaaaaaaaagcaccaggctctaaggtggcaggacatgctaatgtatttgtattcccagaacttcaatctggaaatatcgcttataagatggtgcaacgacttggtaactttactgcagtaggtcctattttacaaggtctagctgctccagttaatgacttatcacgtggttgtagtgaacaagatatttacgatttggctatcgttactgctgcacaagctttggcaaaggatgaaaagtaa

SEQ ID NO: 44 - protein, 329 aa, Lactobacillus acidophilus
MSVFSLFKEQVEQADEKKKIIFPESNDLRILTAVSNLNKDNIIDPILIGKREDIEKLAAENNLDLDGVKIYDQNNYAGLDEMAEAFVKARKKDTSIAEAKAKLAKGNYFGTMLVKMGKADGMVSGAAHSTANTVLPALQLIHAAKGMHRVSGAFVMEKGDERYIFADCAINIDPDEETLAEIGYQSAQTAKMAGIDPKVAFLSFSTKGSAEGPMVNKVHDAAAMFQKDHPEIPADGELQFDAAFVPSVGEKKAPGSKVAGHANVFVFPELQSGNIAYKMVQRLGNFTAVGPILQGLAAPVNDLSRGCSEQDIYDLAIVTAAQALAKDEK

SEQ ID NO: 45 - DNA, 990 bp, Lactobacillus delbrueckii
  CDS (1)..(990): Lactobacillus delbrueckii subsp. bulgaricus ATCC 11842 ; gene Ldb0643 encoding phosphotransacetylase
atggaagtttttgaacaattaaagcaattgattaagcaaaaagacaagcagcggatcgttttcccggaaggggaggacccgcggatcctgacggcggtcagccgcttaaagcaagatgacctggttgaaccgatcgtcctggggcaaaaggaccaggtcctggctttggcggaaaaagctggcttggacatgaccgggatcgaaatcgtggactaccaaaacagcccggactttggcgagatggtggaaaagttccacgaacggatggccgggggcaagcacttccagaccatggaagaagcggaagctgccttgcgcgacgccaacttctacgggaccatgctggtttacaccggccaggccgacgggatggtgtccggggcggctcactcaacggccgacacggtccggccagccctcttcattttgaagaccaagccggggatgcaccggatttccggttccttcatcatggaaagaggggaagaaaagtatgtctttgctgactgcgcgatttccatcgacccgaccagcgaccagctggttgaattcgcggcccagtcagctgctacggccaagatgatcgggattgaccccaaggtggccttcctcagcttctcaacccacggctcagccaagggcccgcaggtagacaaggtggcagaagcggccaagctgttcaaggaaaagtacccggacatcccggcagacggcgatttgcagtttgacgcggccttcgtgccggcagttgctgaacttaaggcacctggttcagccgttggcggcagggctaatgtctttatcttcccggaactgcagtcaggcaacattgcctacaagattacccagcgcctgggcaactttacggccatcgggccggttttgcaggggattgccaagccggtcaacgacctctcccggggctgcagcgctgatgacgtctacaagatcgggattttgacggcggctcaagccgttatggaagggtag

SEQ ID NO: 46 - protein, 329 aa, Lactobacillus delbrueckii
MEVFEQLKQLIKQKDKQRIVFPEGEDPRILTAVSRLKQDDLVEPIVLGQKDQVLALAEKAGLDMTGIEIVDYQNSPDFGEMVEKFHERMAGGKHFQTMEEAEAALRDANFYGTMLVYTGQADGMVSGAAHSTADTVRPALFILKTKPGMHRISGSFIMERGEEKYVFADCAISIDPTSDQLVEFAAQSAATAKMIGIDPKVAFLSFSTHGSAKGPQVDKVAEAAKLFKEKYPDIPADGDLQFDAAFVPAVAELKAPGSAVGGRANVFIFPELQSGNIAYKITQRLGNFTAIGPVLQGIAKPVNDLSRGCSADDVYKIGILTAAQAVMEG

SEQ ID NO: 47 - DNA, 978 bp, Lactobacillus casei
  CDS (1)..(978): Lactobacillus casei ATCC 334; gene LSEI_0996 encoding phosphotransacetylase
  tRNA (1)..(3): Met inserted by tRNA at start codon (TTG) instead of Leu
ttggacctatttgaaagtttaaaagacaagattaatggcaaaaatttacggattgtatttccggaaggcgaagatccgcgcgttttgggcgcagcagttcggctcgcagctgacgggttgatacaggccatcgtgctaggtaatcctgataagattcagacattggcagctgctaaaagctgggatctcagcaagttgacagttcgcgatccagccaacgatgaccttcacgctaaaatggttgcggcctttgttgagcgtcgcaaaggcaaggcaaccccagaacaggccgaaaaaattgttcaggatgccaattattttggtacgatgctggtttacatgaaggaagcagacggtatggtttcaggcgcagttcattcaacggctgacacagtccggcctgctttgcaaattatcaagacgcgtcctggcgtgcatttggtcagtggtgcgttcattatgcagcgtggccgtgacgaacgctacttattcgcggataacgccatcaacattgatccagatgctgatcagctggctgaaattgcggttgagtcagctaaaactgctgccttgtttgatatcgaaccaccgcgcgtcgccttgctgtcattctcaaccaaaggcagtgctaagggaccgcaagtagataaggtagttgaagccactaagaaagctcatgaactggcacctgatttggccttagacggtgagttacaatttgatgctgcttttgtcccaaccgttgccaagcaaaaagcccctgattccaaagtggctggggaagcgaatgttttcattttccctgaattacaatccggtaatattggttataagattgcgcaacgattcggcgggtttgaagccattggcccaattttgcaaggtttgaatcagccagtttctgatttgagtcgtggggcaaatgaagaggatgtctataagttggccattattacagcggcccagaccttgctatga

SEQ ID NO: 48 - protein, 325 aa, Lactobacillus casei
LDLFESLKDKINGKNLRIVFPEGEDPRVLGAAVRLAADGLIQAIVLGNPDKIQTLAAAKSWDLSKLTVRDPANDDLHAKMVAAFVERRKGKATPEQAEKIVQDANYFGTMLVYMKEADGMVSGAVHSTADTVRPALQIIKTRPGVHLVSGAFIMQRGRDERYLFADNAINIDPDADQLAEIAVESAKTAALFDIEPPRVALLSFSTKGSAKGPQVDKVVEATKKAHELAPDLALDGELQFDAAFVPTVAKQKAPDSKVAGEANVFIFPELQSGNIGYKIAQRFGGFEAIGPILQGLNQPVSDLSRGANEEDVYKLAIITAAQTLL

SEQ ID NO: 49 - DNA, 978 bp, Lactobacillus plantarum
  CDS (1)..(978): Lactobacillus plantarum WCFS1; gene lp_0807 encoding phosphotransacetylase
atggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaa

SEQ ID NO: 50 - protein, 325 aa, Lactobacillus plantarum
MDLFESLAQKITGKDQTIVFPEGTEPRIVGAAARLAADGLVKPIVLGATDKVQAVANDLNADLTGVQVLDPATYPAEDKQAMLDALVERRKGKNTPEQAAKMLEDENYFGTMLVYMGKADGMVSGAIHPTGDTVRPALQIIKTKPGSHRISGAFIMQKGEERYVFADCAINIDPDADTLAEIATQSAATAKVFDIDPKVAMLSFSTKGSAKGEMVTKVQEATAKAQAAEPELAIDGELQFDAAFVEKVGLQKAPGSKVAGHANVFVFPELQSGNIGYKIAQRFGHFEAVGPVLQGLNKPVSDLSRGCSEEDVYKVAIITAAQGLA

SEQ ID NO: 51 - DNA, 972 bp, Pediococcus pentosaceus
  CDS (1)..(972): Pediococcus pentosaceus ATCC 25745; gene PEPE_0337 encoding phosphotransacetylase
atggatttatttgaaggtttgaagtcaaaaattaagggccaaaatagaacagttgtatttcccgaaggtgaagatgttcgagttttagctgccgctattcgactagctgatgatggcttagttcaatcaatcttactcggagtggaagctgatattaaagctactgctgaaaagcatggattaaaccttgaaaatgtgcaaattattgatccgagccaatatccggaagccgatcaaaaggaaatgattgataagttagttgaacgtcgtaagggtaaaaataccgaagaacaggttatcgaaatgctcaaagatgtaaattacttcggaactatgctagtttacttaggcaaggcggatgccatggtatctggagcagttcatgctactggtgatacagttcgccccgctcttcaaattatcaagactaaaccaggaatgcgtcgaattagtggagcatttatcatgcaacgcgaaaatgaacgctatgtctttggggatgcagctattaatattgatcccgatgcagaaacattggctgaaattgcgattcaaagtgcagaaactgctcgcctatttgacatcgaccctaaggttgcaatgttaagcttttcaactaaaggctcagcggctggaccaatggtagataaagttcgcgaagctactaaggttgcccaagaacgtgatccaaagaccccatatgatggtgaacttcagtttgatgcagcctttgttccagctgttggagcaagtaaggctccagattcagaaattgcaggacatgcgaatgtctttatcttccctgaacttcaatctggaaacattggttataagattgctcaacgtctaggcggttttgaagcaattggcccaatcttgcaaggacttaatgcaccggtttccgatttatctcgtggagctagtgaagaagatgtctataaagtagcaattattaccgcagctcaagtttag

SEQ ID NO: 52 - protein, 323 aa, Pediococcus pentosaceus
MDLFEGLKSKIKGQNRTVVFPEGEDVRVLAAAIRLADDGLVQSILLGVEADIKATAEKHGLNLENVQIIDPSQYPEADQKEMIDKLVERRKGKNTEEQVIEMLKDVNYFGTMLVYLGKADAMVSGAVHATGDTVRPALQIIKTKPGMRRISGAFIMQRENERYVFGDAAINIDPDAETLAEIAIQSAETARLFDIDPKVAMLSFSTKGSAAGPMVDKVREATKVAQERDPKTPYDGELQFDAAFVPAVGASKAPDSEIAGHANVFIFPELQSGNIGYKIAQRLGGFEAIGPILQGLNAPVSDLSRGASEEDVYKVAIITAAQV

SEQ ID NO: 53 - DNA, 981 bp, Leuconostoc mesenteroides
  CDS (1)..(981): Leuconostoc mesenteroides subsp. mesenteroides ATCC 8293; gene LEUM_1466 encoding phosphotransacetylase
atggaactttttgagcaattaaaaaataaaattaccggtcaaaataagacaattgtatttccggaaggtgaagatccccgtatccagggcgcagctatcagattagcagctgataatttgatcgagccaatattgttgggggatgcacaggaaatttcaaaaactgcccaagcccataactttgatttatcgaacatagagacgattgatcctgcttcatatgatgagaatgaattggcaaaattaaatgcgacacttgtcgaaaggcgcaaagggaaaacagacgctgagacagctgccaaatggctacaaaatgttaactattttgggacaatgctggtttatactggcaaagctgacggtatggtgtcaggcgcagtacatccaactggtgatacagttcgtcctgcgttgcagatcattaaaacggcgcctggctcatcacgtatttctggtgcattcattatgcaaaaaggcgaagagcgttatgtatttgcggacgctgccattaacattgacattgattcggacacgatggctgaaattgcaatacaatcagcccacacagctcaagtgtttgatattgaaccaaaagttgcgatgctttcattttcaactaagggctccgcgaaatcacccttggtcgataaggtggcaactgccactgcattggctaagaagttagcacctgaactggcggactcaattgatggagagttacagtttgatgctgcgtttgttgaatctgttgctgccgcaaaggcgcctgattcaaaagtcgcaggtaaagcgaacacatttattttcccaagtctagaagcaggtaatattggctataaaattgcacaacgcttgggtgggtttgaagcgattggacctattttacaaggcttagcaaaacctgtttctgatttatcgcgaggagccaatgaagaggatgtttataaagtagctattattactgctgcgcaagcattataa

SEQ ID NO: 54 - protein, 326 aa, Leuconostoc mesenteroides
MELFEQLKNKITGQNKTIVFPEGEDPRIQGAAIRLAADNLIEPILLGDAQEISKTAQAHNFDLSNIETIDPASYDENELAKLNATLVERRKGKTDAETAAKWLQNVNYFGTMLVYTGKADGMVSGAVHPTGDTVRPALQIIKTAPGSSRISGAFIMQKGEERYVFADAAINIDIDSDTMAEIAIQSAHTAQVFDIEPKVAMLSFSTKGSAKSPLVDKVATATALAKKLAPELADSIDGELQFDAAFVESVAAAKAPDSKVAGKANTFIFPSLEAGNIGYKIAQRLGGFEAIGPILQGLAKPVSDLSRGANEEDVYKVAIITAAQAL

SEQ ID NO: 55 - DNA, 984 bp, Streptococcus thermophilus
  CDS (1)..(984): Streptococcus thermophilus CNRZ1066; gene str1455 encoding phosphotransacetylase
atgcgtagtctatttggtgaacttcgtgaacatatttcagggaaaggagttaggattgttttccctgagggtaatgatgaccgtgtggttcgtgcagctgcccgtttgaaatttgaagaattagttgatcctattattttgggagaccctacagaggttcacaaaatcttgaacgatcttggttttgtagactttaactgtactattattaatcctgaaacctatgaaggcttcgaggaaatgaaggaaaaatttgttgaagtccgtaaagggaaagcgacaattgaagatgcagacaagttgcttcgtgatgtcaactattttggtgttatgctagttaaacttggtttagcagatggaatggtttcaggcgcgattcactcaacagcggataccgttcgtcctgctcttcaaattatcaaaacgaaacctggtatttcttgtacatcaggtgtcttccttatgaaccgtgaagataccaatcatcgcttgatgtttgccgactgtgctatcaatattgaaccaaattctcaagaattagcagaaattgcaattaatactgcagaaacagctaaagtttttggtattgatcctaaagtggcaatgcttagcttctcaacaaaaggttccgctaaatcaccaaaagttgacagggttgttcaagcaacaaatattgctaaagaaatgcgtcctgacttggctattgatggtgagttgcagtttgatgcagcctttgttccagcaacagcagctattaaggcaccagacagtgacgtagcaggacaagctaacgtctttgtcttcccatgtttacaggctggtaatattggttataagattgcccaacgtttgggaatgtttgaggctatcggaccaatcttacaaggtcttaataaaccagtaaacgatctttctcgtggtgctagtgctgaagatatttacaacttagctattatcacagctgctcaagctcttaataattaa

SEQ ID NO: 56 - protein, 327 aa, Streptococcus thermophilus
MRSLFGELREHISGKGVRIVFPEGNDDRVVRAAARLKFEELVDPIILGDPTEVHKILNDLGFVDFNCTIINPETYEGFEEMKEKFVEVRKGKATIEDADKLLRDVNYFGVMLVKLGLADGMVSGAIHSTADTVRPALQIIKTKPGISCTSGVFLMNREDTNHRLMFADCAINIEPNSQELAEIAINTAETAKVFGIDPKVAMLSFSTKGSAKSPKVDRVVQATNIAKEMRPDLAIDGELQFDAAFVPATAAIKAPDSDVAGQANVFVFPCLQAGNIGYKIAQRLGMFEAIGPILQGLNKPVNDLSRGASAEDIYNLAIITAAQALNN

SEQ ID NO: 57 - DNA, 990 bp, Oenococcus oeni
  CDS (1)..(990): Oenococcus oeni PSU-1; gene OEOE_1435 encoding phosphotransacetylase
atgacaaatttatttactgagttggctgataaaattaaggaaaaaaaactgagactcgtttttccggaaggcgatgattcaagagtccagggggcggccatccgtttaaaaaaagatggtttactaacgccgatattattgggagatcaggcagcggtcgaaaagacagctgcagataatcatttcgacctgagtggcatcaagcttatcgatccgcttaaattcgatgagaagcagttcaatcaattgatcgataaactggttacccgacgaaaagggaaaactgacccgcaaacggtagctatgtggctgcaggaagtaaattatttcggtaccatgcttgtttataccggcaaggccgacgcaatggtttccggtgctgttcatccaaccggcgatacggttcgtcccgctttgcagattatcaagacagctcctggtgtcagtcgtatttccggtgcttttattatgcaaaaaaatgatgaacgctatctgtttgccgattcggcaattaatatcgaacttgatgcacaaaccatggctgagattgccgttcaatcagcccatacggctaaaatatttggaatcgatccaaaagttgccatgctgagtttttcaaccaaaggatcggcaaaacatgcattggtcgataaagttgctcaggcaactaagctggcgcaggagatggcaccggatttagctgataatattgatggtgaattacaattcgatgcagcttttgtcgaatcggttgccaaattaaaagctccgggatcaaaagtggccggtcatgcgaacgttttcatttttccaagtttggaagccggaaatattggttataaaattgcccaacgcttgggtggatacgaagcaattggtcctattttgcaaggattggcagcacctgtttccgatctgtcgcgtggagcaagtcaagaagacgtatataaagttgcaattattactgctgctcaggctttaaaaaattag

SEQ ID NO: 58 - protein, 329 aa, Oenococcus oeni
MTNLFTELADKIKEKKLRLVFPEGDDSRVQGAAIRLKKDGLLTPILLGDQAAVEKTAADNHFDLSGIKLIDPLKFDEKQFNQLIDKLVTRRKGKTDPQTVAMWLQEVNYFGTMLVYTGKADAMVSGAVHPTGDTVRPALQIIKTAPGVSRISGAFIMQKNDERYLFADSAINIELDAQTMAEIAVQSAHTAKIFGIDPKVAMLSFSTKGSAKHALVDKVAQATKLAQEMAPDLADNIDGELQFDAAFVESVAKLKAPGSKVAGHANVFIFPSLEAGNIGYKIAQRLGGYEAIGPILQGLAAPVSDLSRGASQEDVYKVAIITAAQALKN

SEQ ID NO: 59 - DNA, 972 bp, Bacillus coagulans
  tRNA (1)..(3): Met inserted by tRNA at start codon (GTG) instead of val
  CDS (1)..(972): Bacillus coagulans 36D1; gene Bcoa_1406 encoding phosphotransacetylase
gtgagtacattttttgacgggataaaagaaaaagtgcggggacataacaaaacgattgtttttccggaaagttcggatgaaagggttttaacagccgtctcccggtttgcagccgatgaagtactccggccggttttaatcgggaacaaggataaaattcaggcaaaagcccaggccatcggtgtttctgtcaagggcgttacagtgtatgacccggaagactatgccggttttgaagaaatggtgcaggcttttgtggaacgaagaaaaggcaaagcgacggaggaagatgcgcgccaaattttaaaagacgtcaattatttcggcaccatgctcgtctatttgaaaaaagcggacggtctggtaagcggtgccatccattcaacggcagatacagtccggccggcattgcagatcattaaaacaaaaccgggcgtgaaaaaagtttctggcgttttcattatggtgaggggcgaagagaaatttgttttcgccgattgtgcaatcaatatttcaccggacagccaagacttggcggaaacggccgtggagagcgcgaaaactgcccggacatttgatattgaaccgaggattgcgatgttgagcttttcaacaagaggttccgcccattccgatgagacggagaaagtggcgcaggcagtccgattggctaaagagcgcgatccggagcttgtcatggacggcgagatgcagtttgatgccgcgtatgtgccggctgtggcgcaaaagaaagcgccggattccgtgattcaggggaatgcaactgtgtttatttttccaaatctggatgcggggaatatcggttataaaatggcccagcgtcttggcggttttgaagcagtcggtccgattttgcaagggctgaatgcgcctgtcaacgatttgtcgcgcggctgcaatgcggaagatgtttatcatttggctttgatttccgcagcacaaagtttgtaa

SEQ ID NO: 60 - protein, 323 aa, Bacillus coagulans
VSTFFDGIKEKVRGHNKTIVFPESSDERVLTAVSRFAADEVLRPVLIGNKDKIQAKAQAIGVSVKGVTVYDPEDYAGFEEMVQAFVERRKGKATEEDARQILKDVNYFGTMLVYLKKADGLVSGAIHSTADTVRPALQIIKTKPGVKKVSGVFIMVRGEEKFVFADCAINISPDSQDLAETAVESAKTARTFDIEPRIAMLSFSTRGSAHSDETEKVAQAVRLAKERDPELVMDGEMQFDAAYVPAVAQKKAPDSVIQGNATVFIFPNLDAGNIGYKMAQRLGGFEAVGPILQGLNAPVNDLSRGCNAEDVYHLALISAAQSL

SEQ ID NO: 61 - DNA, 2712 bp, Lactococcus lactis
  CDS (1)..(2712): Lactococcus lactis subsp. cremoris MG1363; gene llmg_2432 encoding alcohol dehydrogenase
atggcaactaaaaaagccgctccagctgcaaagaaagttttaagcgctgaagaaaaagccgcaaaattccaagaagctgtcgcttatactgatcaattagtcaaaaaagctcaagctgcagttcttaaatttgaaggatacacacaaactcaagttgatactattgttgctgcaatggctcttgcagcaagcaaacattctctggaactcgctcacgaagccgttaatgaaactggccgtggagttgttgaggacaaagatacaaaaaaccattttgcttctgaatctgtttataatgcaatcaaaaatgataaaacagttggcgttatcgctgaaaacaaagttgctggttctgttgaaatcgcaagcccccttggagtacttgctggtattgtcccaacaactaatccaacatcaacagccatctttaaatcattattaactgcaaagacacgtaatgctattgtctttgcctttcacccacaagcacaaaaatgctcaagccatgcggcaaaaattgtttatgatgctgcgattgaagctggtgcacctgaagactttattcaatggattgaagtacccagtcttgatatgacgactgctttgattcaaaatagaggaattgctacaattcttgcaactggtggtccaggtatggtcaatgccgcgcttaagtctggtaatccttcacttggtgtaggtgctggtaatggtgcagtttatgttgatgcaactgcaaatatcgatcgtgctgttgaagatcttttgctttcaaaacgttttgataacggaatgatttgtgcgactgaaaactctgcagttattgatgcatcaatctatgatgaatttgtcgctaaaatgcaagcgcaaggcgcttatatggttcctaaaaaagattacaaggcaattgaaagttttgttttcgttgaacgtgctggtgaaggttttggtgtaactggtcctgttgctggtcgttctggtcaatggattgctgaacaagctggtgttaacgtccctaaagataaagatgttcttctttttgaacttgataagaaaaatattggggaagctctttcttctgaaaaactttctcctttgctttcaatctacaaatcagaaacacgtgaagaaggaattgaaattgtacgtagcttacttgcttaccaaggagctggtcacaacgctgccattcaaatcggtgcaatggacgacccatttgtcaaagaatacggaattaaagtcgaagcttctcgtatcctcgttaaccaacctgactctatcggtggggtcggagatatttatactgatgcaatgcgtccatcattgacgctcggaactggttcatgggggaaaaattcactttcacacaatttgagtacatacgatctattgaatgttaaaacagtggctaaacgtcgtaatcgccctcaatgggttcgtttgccaaaagaaatttactacgaaaaaaatgcaatttcttacttacaagaattgccacacgtccacaaagctttcattgttgccgaccctggtatggttaaattcggtttcgttgataaagttttggaacaacttgctatccgcccaactcaagttgaaacaagcatttatggctcagtccaacctgacccaactttgagtgaagccattgcaatcgctcgtcaaatgaaacaatttgaacctgacactgtcatctgtcttggtggtggttctgctctcgatgctggtaagattggtcgtttgatttatgaatatgatgctcgtggtgaggctgacctttccgatgacgcaagtttgaaagagatcttccaagagttagctcaaaaatttgttgatattcgtaaacgtattatcaaattctaccacccacacaaagcacaaatggttgctatccctactacttctggtactggttctgaagtgactccatttgcggttatcactgatgatgaaactcacgttaaatatccacttgctgactatcaattgacacctcaagttgccattgttgaccctgagtttgttatgactgtaccaaaacgtactgtttcttggtctgggattgatgctatgtcacacgcgcttgaatcttatgtttctgtcatgtcttctgactatacaaaaccaatttcacttcaagccatcaaactcatctttgaaaacttgactgagtcttatcattatgacccagctcatccaaccaaagaaggtcaaaaagctcgcgaaaacatgcacaatgctgcaacactcgctggtatggccttcgccaatgctttccttggaattaaccactcacttgctcataaaattggtggtgaatttgggcttcctcatggtcttgccattgctatcgctatgccacatgtcattaaatttaacgctgtaacaggaaacgttaaacgtaccccttacccacgttatgaaacttatcgtgcgcaagaagactacgctgaaatttcacgcttcatgggatttgctggcaaagaagattcagatgaaaaagcggtcaaagctttggttgctgaacttaaaaaattgactgatagtattgatattaatatcaccctttcaggaaatggtgtagataaagctcatcttgaacgtgagcttgataaattggctgaccttgtttacgatgaccaatgtacacctgctaatccacgtcaaccaagaattgatgagattaaacaactcttgttagaccaatattaa

SEQ ID NO: 62 - protein, 903 aa, Lactococcus lactis
MATKKAAPAAKKVLSAEEKAAKFQEAVAYTDQLVKKAQAAVLKFEGYTQTQVDTIVAAMALAASKHSLELAHEAVNETGRGVVEDKDTKNHFASESVYNAIKNDKTVGVIAENKVAGSVEIASPLGVLAGIVPTTNPTSTAIFKSLLTAKTRNAIVFAFHPQAQKCSSHAAKIVYDAAIEAGAPEDFIQWIEVPSLDMTTALIQNRGIATILATGGPGMVNAALKSGNPSLGVGAGNGAVYVDATANIDRAVEDLLLSKRFDNGMICATENSAVIDASIYDEFVAKMQAQGAYMVPKKDYKAIESFVFVERAGEGFGVTGPVAGRSGQWIAEQAGVNVPKDKDVLLFELDKKNIGEALSSEKLSPLLSIYKSETREEGIEIVRSLLAYQGAGHNAAIQIGAMDDPFVKEYGIKVEASRILVNQPDSIGGVGDIYTDAMRPSLTLGTGSWGKNSLSHNLSTYDLLNVKTVAKRRNRPQWVRLPKEIYYEKNAISYLQELPHVHKAFIVADPGMVKFGFVDKVLEQLAIRPTQVETSIYGSVQPDPTLSEAIAIARQMKQFEPDTVICLGGGSALDAGKIGRLIYEYDARGEADLSDDASLKEIFQELAQKFVDIRKRIIKFYHPHKAQMVAIPTTSGTGSEVTPFAVITDDETHVKYPLADYQLTPQVAIVDPEFVMTVPKRTVSWSGIDAMSHALESYVSVMSSDYTKPISLQAIKLIFENLTESYHYDPAHPTKEGQKARENMHNAATLAGMAFANAFLGINHSLAHKIGGEFGLPHGLAIAIAMPHVIKFNAVTGNVKRTPYPRYETYRAQEDYAEISRFMGFAGKEDSDEKAVKALVAELKKLTDSIDINITLSGNGVDKAHLERELDKLADLVYDDQCTPANPRQPRIDEIKQLLLDQY

SEQ ID NO: 63 - DNA, 2631 bp, Lactobacillus acidophilus
  CDS (1)..(2631): Lactobacillus acidophilus NCFM; gene LBA0461 encoding alcohol dehydrogenase
atggctaaggcacaacaaaaagaaactcctactgaggaagaaaagaaaaagcaaatctacgacatggtagataatttagtaaaaagatcacatgttgcattagatgaaatggctaacttcacacaagaacaagttgataagatctgtgaagcagttgctactgcaggtgaacaaaacgcttacccactagctaaaatggctgttgaagaaactaagcgtggtgtagtagaagataagactactaaaaacatgtacgctagtgaaaatatttggaacagtttacgccacgaaaaaactgttggtgtaattgaagaagataaggaactaggattaactaagattgctgaacctaagggtgttattgccggtgttactccagtaactaacccaacttcaactgttattttcaaagcaatgcttgctctaaagacgagaaatactattatttttggtttccacccacaagctcaaaaatgttgtgtagaaactggtaaaattatccaagcggctgctgttgctgcaggtgcacctaaagatgcaattttatggattgaagagccaagtttggatgcaaccactgatttaatgaataatccaggtgttcaaactattttggccactggtggtccaggtatggttaaggctgcatattcatcaggtaaaccagctatcggtgttggtcctggtaatggtccttcatacattgaaaaatcagctaatatcggtcgtgctgtttatgatattgttttatcaaagaacttcgataacggtatggtttgtgcttctgaaaactcagtcgttgtagatgacgcaatttatgacaaggctgtagaagaatttaagaagtggggttgttacttcttaaataaagaagaaattaagaaatttgaagaacactttattgatccaagacgtggtactgttgcaggtcctgtagctggtaaatcagcttatgaaattgctaaactttgtggtgttgatgtaccaaagactactaaagtaattgttgctgaatacaaaggtgttggtagaaagttcccactttcagctgaaaaactttctcctgtctttactttatatcgcgctaagaatcatgacgatgcatttaagatttgttctgaacttcttgattatggtggtcgtggtcataccgcgggaattcactcaagcgatcaaaatataattgatgaatttgcaatgaagatggatgcttgtcgtattctagttaattcaccagctgcacttggtggtattggtgatctttacaacaatatgttgccttcacttacattaggtacaggttcatacggtgctaacacattttcacacaatattggtgccagagatttacttaatattaaaacggttgcgaaacgtcgcgacaatatgcaatgggtaaaagttccatcaaagacttactttgaacataatgctgctaattatttgcgtcacatgccaaatgttaaccgtttcttcattgttactgatgaaggcgtagctgaccaaggctttgctgacgaaatcactgatattatttctaagcgtcgtggtcaaaaagaatatgaagtatttaaggctgtaacgcttgatcctgatactgatgtaattaaagacggtgttcacagaatgaacatctttaagcctgacgtaattattgctattggtggtggctcagtaatggatgctgctaaagtaatgcgcttattctacgaaaatccagaaatgagctttgaagaagcttaccaaaagtttttggatatcagaaaaagagtagtccgcttccctaagattaatggtgttcaacttgtatgtattccaacaacttctggtactggttcagaagtttccccaattgcagttattagcgatactaaaacaggtatgaaacacactctttgtgattatgctttaactccagatgtttcaattgttgatgatcaatttgttcaaaatatgcctaaacgcttaattgcttggtcaggttttgaagcattaggtcatgctattgaaagctatgtttcaactatggccactgatttcactcgtggttggtcacttgaagctattaaagcgatctttgcaaacttgaagaagtcatacgatggtgatcttgatgcaagaaagcaaatgcatgatgctgcaactattgcaggtatggcatattcaaatgcattccttggtcttgaacactcaattgctcatactgttggctcaacctttgatattccaagcggagtaagtgatgcgattgctttaccgcaagttattcgctttaatgccaaacgtcctgaaaagctcgctatgtggcctcactactcagtatatcgtgctgaaagtgactatgctgatattgcaagagctatcggtttgactggttcaagtgatgctgaattagttgaaaaactggttcaaaagattattgaattggctcattctgttggtattaagatggcttataaggattatggcgttgacaagactgaatttgataagaaagttgatcaaatggcagttgaagcttatggtgatcaaaatactgtaactaatccatcagcaccacttattacacaaattgttgtcttaatgaaagattgctacgaaggcaaaggtatttcagacaatgataaataa

SEQ ID NO: 64 - protein, 876 aa, Lactobacillus acidophilus
MAKAQQKETPTEEEKKKQIYDMVDNLVKRSHVALDEMANFTQEQVDKICEAVATAGEQNAYPLAKMAVEETKRGVVEDKTTKNMYASENIWNSLRHEKTVGVIEEDKELGLTKIAEPKGVIAGVTPVTNPTSTVIFKAMLALKTRNTIIFGFHPQAQKCCVETGKIIQAAAVAAGAPKDAILWIEEPSLDATTDLMNNPGVQTILATGGPGMVKAAYSSGKPAIGVGPGNGPSYIEKSANIGRAVYDIVLSKNFDNGMVCASENSVVVDDAIYDKAVEEFKKWGCYFLNKEEIKKFEEHFIDPRRGTVAGPVAGKSAYEIAKLCGVDVPKTTKVIVAEYKGVGRKFPLSAEKLSPVFTLYRAKNHDDAFKICSELLDYGGRGHTAGIHSSDQNIIDEFAMKMDACRILVNSPAALGGIGDLYNNMLPSLTLGTGSYGANTFSHNIGARDLLNIKTVAKRRDNMQWVKVPSKTYFEHNAANYLRHMPNVNRFFIVTDEGVADQGFADEITDIISKRRGQKEYEVFKAVTLDPDTDVIKDGVHRMNIFKPDVIIAIGGGSVMDAAKVMRLFYENPEMSFEEAYQKFLDIRKRVVRFPKINGVQLVCIPTTSGTGSEVSPIAVISDTKTGMKHTLCDYALTPDVSIVDDQFVQNMPKRLIAWSGFEALGHAIESYVSTMATDFTRGWSLEAIKAIFANLKKSYDGDLDARKQMHDAATIAGMAYSNAFLGLEHSIAHTVGSTFDIPSGVSDAIALPQVIRFNAKRPEKLAMWPHYSVYRAESDYADIARAIGLTGSSDAELVEKLVQKIIELAHSVGIKMAYKDYGVDKTEFDKKVDQMAVEAYGDQNTVTNPSAPLITQIVVLMKDCYEGKGISDNDK

SEQ ID NO: 65 - DNA, 2607 bp, Lactobacillus casei
  CDS (1)..(2607): Lactobacillus casei ATCC 334; gene LSEI_0775 encoding alcohol dehydrogenase
atgttaaagaatactgcgaagactgctaccgaagttgatgtaaagagcatggttgacgaactggttgcgaatgcgcatgccgctttgaagatcatgaaaactttcgatcaagaaaagatcgatcacatcgttcatcggatggcaatcgctggtttggatcatcatatggaattggcaaaactcgctgttgacgagacgggccgtggcgtgtgggaagataaagcgatcaagaacatgttcgccaccgaagaaatttggcactcaatcaagaacaacaagaccgttggtgtgatcaacgaagacaaacaacgcggcttggtatcgattgctgaaccaattggtgtcattgctggtgtgacgccagtgacgaacccaacttcaacgaccatgttcaaatccgaaattgccattaaaacccgtaatccaatcattttcgctttccatccgggtgcccaaaagtcttcagcgcgtgcgttggaggtcatccgtgatgaagccgaaaaagcaggcttaccaaagggtgctttgcaatatatccctgtaccaagtatggatgcgactaaagctttgatggatcaccctggtatcgccacgattttggcaacgggcggtcctggcatggttaagtccgcctattcatcaggcaagccagcactgggtgttggggccgggaatgcgccagcttacattgaagccagcgctaacatcaaacaagctgtcaatgacttagtactttcaaagagttttgataatggtatgatttgtgcttccgaacaaggcgtgattattgattccagcatttacgatgatgtgaagaaggaatttgaagcccaaggtgcttacttcgttaaacagaaggacatgaagaagttcgaaagtaccgtcattaatcttgaaaagcaaagtgtcaatccgcgaatcgttggtcaaagtcctaagcagattgctgaatgggcggggatcacgattcctgataacaccacgattctgattgctgaattgaaaggtgttggcgaaaagtatccactgtctcgtgaaaaactaagtccagtactggccatggtcaaagcagatggtcatgaagatgccttcaagaaatgtgaaaccatgcttgatatcggcggtttgggtcatacggcagtcattcacacggctgatgatgagttagctttgaagtatgccgatgctatgcaagcttgccggattttgatcaacacaccatcttctgtcggcgggattggcgatctttacaacgaaatgattccaagtttgacactgggctgcggctcatacggtggtaactcaatttcgcataacgtggggacggtcgacttgcttaacatcaagacaatggcaaaacgccgcaataacatgcagtggatgaaattgccaccaaagatctattttgaaaagaattctgttcgttacctcgaacacatggaaggcatcaaacgggccttcatcgttgctgatcgaagcatggaaaagttaggcttcgtcaagatcgttgaagatgttctggctcggcgtgaaaatcctgttcaagttcagacttttgtcgatgttgaacctgatccatcaactgacacggtcttcaaggggaccgatatcatgcgctcatttggaccggataccgtcattgctatcggcggcgggtctgttatggatgctgccaaagggatgtgcttgttcaacgatgccggggatgctgatttcttcggcgctaagcagaaattcttggatatccggaagcggacttacaccttcccgaatctgaataagacaaagcttgtctgcattccaacaacttctgggactggttcagaagtaacaccttttgcggttatcaccgattccaaggctggcatcaagtatccgttagctgactatgcattgacgccagacatcgcgattgtggacagtcagttcatcgaatccgtaccgccagtggttgtcgctgattccggtttggatgtgctctgccacgcaaccgaaagttatgtttcgaccatggccactcattacacgaagggcctgagtttggaagcaatcaagttggtcttcgaaaatctggaaaagagttatcatggcgacgtcgaagcaaagtcaaagatgcatgatgcttcaaccattgccgggatggcctttgccaacgcactgttgggcattaaccacagcattgcgcataagattgggcaagcgttccatctgcctcacggtcgttgcatcgcgatcacgatgccacatgttattcgcttcaatgcgagtcaaccgaagaagcgcgctatctgggcgaagtatagctacttccgcgctaacgaagactacgcagaaatcgctcgctaccttggccttcctggcaagacaactgatgaattggttgaaagctatgtccaggccttcatcaagctggctcacagtgttggcgtcaagctcagtttgaaggaacaaggcgttaaaaaggctgatctcgacaagcaagttgatcgtcttgccgaactggcttatgaagacaactgcaccgttaccaacccgcaagaaccgttaatcggcgacttgaagcatatcatccttgatgaatatgaaggcaccgaatccactttctaa

SEQ ID NO: 66 - protein, 868 aa, Lactobacillus casei
MLKNTAKTATEVDVKSMVDELVANAHAALKIMKTFDQEKIDHIVHRMAIAGLDHHMELAKLAVDETGRGVWEDKAIKNMFATEEIWHSIKNNKTVGVINEDKQRGLVSIAEPIGVIAGVTPVTNPTSTTMFKSEIAIKTRNPIIFAFHPGAQKSSARALEVIRDEAEKAGLPKGALQYIPVPSMDATKALMDHPGIATILATGGPGMVKSAYSSGKPALGVGAGNAPAYIEASANIKQAVNDLVLSKSFDNGMICASEQGVIIDSSIYDDVKKEFEAQGAYFVKQKDMKKFESTVINLEKQSVNPRIVGQSPKQIAEWAGITIPDNTTILIAELKGVGEKYPLSREKLSPVLAMVKADGHEDAFKKCETMLDIGGLGHTAVIHTADDELALKYADAMQACRILINTPSSVGGIGDLYNEMIPSLTLGCGSYGGNSISHNVGTVDLLNIKTMAKRRNNMQWMKLPPKIYFEKNSVRYLEHMEGIKRAFIVADRSMEKLGFVKIVEDVLARRENPVQVQTFVDVEPDPSTDTVFKGTDIMRSFGPDTVIAIGGGSVMDAAKGMCLFNDAGDADFFGAKQKFLDIRKRTYTFPNLNKTKLVCIPTTSGTGSEVTPFAVITDSKAGIKYPLADYALTPDIAIVDSQFIESVPPVVVADSGLDVLCHATESYVSTMATHYTKGLSLEAIKLVFENLEKSYHGDVEAKSKMHDASTIAGMAFANALLGINHSIAHKIGQAFHLPHGRCIAITMPHVIRFNASQPKKRAIWAKYSYFRANEDYAEIARYLGLPGKTTDELVESYVQAFIKLAHSVGVKLSLKEQGVKKADLDKQVDRLAELAYEDNCTVTNPQEPLIGDLKHIILDEYEGTESTF

SEQ ID NO: 67 - DNA, 1194 bp, Lactobacillus casei
  CDS (1)..(1194): Lactobacillus casei ATCC 334; gene LSEI_2125 encoding alcohol dehydrogenase
  tRNA (1)..(3): Met inserted by tRNA at start codon (TTG) instead of Leu
ttgaagaattttcgatttcagaataaaaccgatattcgttttggtacaggccgattagatgttgagctgcacgacgcggtgagtcaatttggttcgcgtgttttgttcgtttatggtggccattccatcaaaaagtcaggcttatacgataccgtgactggactgctcgctgatttgcagttaaccgaattgccgggcattgagccgaacccgaagatcgattctatccgtgctggccaaaagctggcgaaggatcaggatattgatgttgttttggcagttggtggcggctccgtcattgatgctgcaaaagtcattgccagcgccaagttttacgaaggcgacccctgggatcttgtcaaagatcgtggtgtaactcgccggaaattgcagcaattgccagtcgtcgatattctgacattagcagcgaccggcagtgagatgaacagtggctccgtgatttcaaatcctgtcactcatgaaaagctcggcacagtcgggccaaacacaccagcggtttcatttttggatccgtcactgacctttactgtgccagccagacaaacggcggcgggatcaatggatattcttagtcatttgcttgaacaatattttgatcgttcaaaaaataatgacgccagcaaaggcatgattgaaggcttgatgcgcacagttattaagtgggcgcccattgcgttgaaacaacccgataactatgatgcccgcgccaacttaatgtggagcgcaacgatggcgctaaacggtatcgtgagtgttgctaacgaaaatggctggacagtgcatagccttgaacatgaactatcagcttattatgacattacccatggtgtcggccttggcattttaacaccgcgttggatgtcgtttattctgaccaaggacgcaacgacagcagaaatgttggcacaatttggtcgccatgtctgggatcttgaaggtgatgaatcttatgccgtggcgcaagcggctattgacgcgacctttgattggattagtcgcttagggttcccgatgaccttgcctgaagttgggatcaaggatactcagcattttgatgccatggcgactgctgctgttgccaatgctagtcttgaaacgcgcgcctatgtgccgttgtcggtagaagatgtcgaaacgatttatcaagcatccatgacagatgggctggcataa

SEQ ID NO: 68 - protein, 397 aa, Lactobacillus casei
LKNFRFQNKTDIRFGTGRLDVELHDAVSQFGSRVLFVYGGHSIKKSGLYDTVTGLLADLQLTELPGIEPNPKIDSIRAGQKLAKDQDIDVVLAVGGGSVIDAAKVIASAKFYEGDPWDLVKDRGVTRRKLQQLPVVDILTLAATGSEMNSGSVISNPVTHEKLGTVGPNTPAVSFLDPSLTFTVPARQTAAGSMDILSHLLEQYFDRSKNNDASKGMIEGLMRTVIKWAPIALKQPDNYDARANLMWSATMALNGIVSVANENGWTVHSLEHELSAYYDITHGVGLGILTPRWMSFILTKDATTAEMLAQFGRHVWDLEGDESYAVAQAAIDATFDWISRLGFPMTLPEVGIKDTQHFDAMATAAVANASLETRAYVPLSVEDVETIYQASMTDGLA

SEQ ID NO: 69 - DNA, 2604 bp, Lactobacillus plantarum
  CDS (1)..(2604): Lactobacillus plantarum WCFS1; gene lp_3662 encoding alcohol dehydrogenase
atgattaagacagaaaaaaatcaaacaagcaaagttactgacgaagttgatcaattagttcaacgttctaagaaagcattagctattttgaagtcatatacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagacgatgaagagcaactaatggaaattgctgaaccagttggtatcgtagccggggttacacccgtaacgaatccaacttcaacaacggttttcaagacgttgatctcattaaaggggcgtaacacgatcgtctttggtttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttggctaccggtggtccaagtatggtgacagccgcttactcatcaggtaaaccagcactgggtgttggtcctggtaacggcccaacttatgttgaaaaaacagctgacattaagcaggcggttaacgacattgttttatcgaagacgtttgataatgggatgatttgtgcttctgaaaatagtgccattatcgacaaggaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttctgaccgtttacaaagcggattcgcatgaagcggcgttcaaacgggctaatgaattacttcactatggtggcttaggccatactgctgggattcatacgaccgatgatgcattggtcaaagaatttggcttacaaatgccagcttgccggatcttagttaacacgccatcttcagttggtgggttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagaaggttttcctagtttgtgatcctgggatggttgaatttggctatgctgatcgagtaacggcggtcttgaacaagcggactgatccggttgatatcgacatcttctcagaagttgaaccgaacccgtcgactgacacagtctacaaaggggttgcccggatgaaggcctttaagccagatacaatcattgcactcggtggtggttctgcaatggacgccgctaaggggatgtggctcttctatgaacacccagaagcttccttcttaggtgctaaacagaagttcctggatatccggaagcggacgtacaaagtaccagtatccgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagccttgcaattagccttcaagtacttgaaagcttcttatgatggtgacaagatggctcgtgagaagatgcacaatgcctcaacgttagctgggatggcctttgccaatgccttcttgggtatcaaccactcgatcgcccataaattaggcggggaattcaacttaccacacggattggcaattgcgatcacttatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcactcaatggatgtgaccttatccttgaaagctaaccgggtcgaaaagaagcactttgacgccaccgtcgacgaattagccgaactggcctatgaagaccaatgcacgaccgctaacccacgcgaacctttaatcagtgaattaaaggcgattattgaacgtgaatgggacggccaaggtactgaaaaatag

SEQ ID NO: 70 - protein, 867 aa, Lactobacillus plantarum
MIKTEKNQTSKVTDEVDQLVQRSKKALAILKSYTQAQIDDLCEKVAVAALDNHMKLAKLAVEETGRGVVEDKAIKNIYASEYIWNSMRHDKTVGVIKEDDEEQLMEIAEPVGIVAGVTPVTNPTSTTVFKTLISLKGRNTIVFGFHPQAQKCSSAAADVMREAIKAAGGPADAVLYIEHPSIEATDALMHHTDVATILATGGPSMVTAAYSSGKPALGVGPGNGPTYVEKTADIKQAVNDIVLSKTFDNGMICASENSAIIDKEIYAEVKAEFIRLGCYYVKPKDVQALSDAVIDPNRHTVRGPVAGKTAYQIAQMAGLKDVAKDCRVLIAEINGVGIKYPLSGEKLSPVLTVYKADSHEAAFKRANELLHYGGLGHTAGIHTTDDALVKEFGLQMPACRILVNTPSSVGGLGNIYNNMAPSLTLGTGSYGGNSISHNVTDMDLINIKTVAKRRNNMQWVKMPPKVYFERNSVRYLEHMAGIKKVFLVCDPGMVEFGYADRVTAVLNKRTDPVDIDIFSEVEPNPSTDTVYKGVARMKAFKPDTIIALGGGSAMDAAKGMWLFYEHPEASFLGAKQKFLDIRKRTYKVPVSEKVTYIGIPTTSGTGSEVTPYAVITDSKTHVKYPITDYAMQPDIAIVDPQFVETVPKRTTAWTGLDVITHATEAYVSTMASDFTRGWSIQALQLAFKYLKASYDGDKMAREKMHNASTLAGMAFANAFLGINHSIAHKLGGEFNLPHGLAIAITYPQVVRYNAEIPTKLAMWPKYNHNTALADYANIARALGLPGKTDEELKESLVKAYIDLAHSMDVTLSLKANRVEKKHFDATVDELAELAYEDQCTTANPREPLISELKAIIEREWDGQGTEK

SEQ ID NO: 71 - DNA, 2703 bp, Leuconostoc mesenteroides
  CDS (1)..(2703): Leuconostoc mesenteroides subsp. mesenteroides ATCC 8293; gene LEUM_0146 encoding alcohol dehydrogenase
atggcagaagcaattgcaaagaaacccgcaaaaagggttttgacccctgaagaaaaagcggaattacaaacacaagctgagaagatgactgaggtattgattgaaaaatcacaaaaggcattgtctgaattttcaacattttcgcaagaacaagttgataaaattgttgcagctatggccttggcaggttctgagaattcacttctgttagcccatgctgctcacgacgagactggacgtggggttgtggaagataaggatacgaaaaatcgtttcgcctcagaatcagtttataacgctattaagtttgataagactgtgggtgttattagtgaagacaagattcaaggtaaggtagaattagcagccccacttggtattttggctggaatcgtcccaacgacaaatccaacgtcgacaactattttcaaatcaatgttgacagcaaagacacgtaacacaattatctttgctttccatccccaggctcaaaaagcatcggttcttgctgcaaaaattgtttatgatgctgctgttaaagcaggcgcaccggaaaactttatccaatggattgaaaagccttcactttatgcaacaagtgcgctgatacaaaatcctcacattgcttcaattctagctactggtgggccatcaatggttaatgcagctttgaagtcaggaaatccatccatgggtgtcggtgctggaaacggtgcagtttatattgatgcaactgttgacacagatcgtgccgtgtccgatttgttgttatcaaagcgtttcgataatggcatgatttgtgccacagaaaactcagccgttattcaagcaccaatctatgacgaaattttaactaagttacaagaacaaggtgcataccttgttcctaagaaagactacaaaaaaattgctgattatgtatttaagcctaacgcagagggatttggtattgctggtcctgttgctggtatgtcaggacgttggattgctgagcaagcaggcgtaaagattcctgatggtaaagatgtacttttgttcgaattagatcagaagaacataggtgaagcgttatcttctgaaaagttatcgccattactttcaatttataaagttgagaagcgtgaagaagctattgagactgttcaatccttgttaaactatcaaggcgcggggcacaacgcagcaattcaaattggttcacaagatgatccattcattaaagagtatgctgacgctattggtgcatcacgtattttggttaaccaacctgactcaatcggtggtgttggagatatttacacagatgctatgcgtccatcgttgacacttggtaccggatcatgggggaagaattcattgtctcataacttatcaacatacgacttacttaatattaagaccgtggctcgccgccgtaatcgtcctcaatgggttcgtttacctaaggaagtttactacgaagccaatgccattacttacttacaagacttgcctactataaaccgtgcatttattgtcgctgatcctggtatggttcagttcggatttgttggcagagtactaggtcaacttgagttacgtcaagaacaggttgaaacaaatatctatggttcagttaagcctgacccaactttgtcacaagctgttgaaattgctcgccaaatggcagacttcaaaccagatacagttattttacttggcggtggttcggcacttgacgctggtaaaattggtcggttcttgtacgaatactcgacacgccatgaaggaattttagaagatgacgaggcgattaaagatctattcttagaactacaacaaaagtttatggatattcgtaagcgaatcgttaagttttaccacgcacgtttgacacaaatggttgcgattccaacaacttcaggtactggatcagaagtcacaccatttgccgttattacagatgatgaaacacatgtaaagtatccactagccgattatgaattgacaccggaagttgctattgttgatccagaatttgttatgaccgtaccacaacacacggtatcttggtcaggattagatgctttgtcacatgctttggaatcgtatgtctcagtgatggcttctgaattcacacgtccttgggcattacaagctattaagttgatttttgataacttaacaaattcatacaattatgatcctaaacacccaactaaggaaggtcagaatgcacgcacaaagatgcactatgcgtcaacattggctggtatgtcatttgcgaatgccttcttgggacttaaccactcactagcacacaaaactggtggagaattcggactacctcacggtatggcaatcgctattgcaatgccacatgtgattaagtttaatgcggtaacaggaaatgtaaagcgcacaccatacccacgttacgaaacctatacagcacaaaaagattatgctgatattgcacgttacttaggtttgaaaggtgaaacagatgctgaattggtcgatgtattgattgcagaaatcaagaagttggctgcatcagtgggtgtcaatcaaacactatctggcaacggtgtttcaaagcatgactttgatacaaagttagaaaagatgattgacttagtttacaatgaccaatgcacgccgggaaaccctcgccaaccaagcttggcagaaattcgtcaattgttgaaagatcagttttaa

SEQ ID NO: 72 - protein, 900 aa, Leuconostoc mesenteroides
MAEAIAKKPAKRVLTPEEKAELQTQAEKMTEVLIEKSQKALSEFSTFSQEQVDKIVAAMALAGSENSLLLAHAAHDETGRGVVEDKDTKNRFASESVYNAIKFDKTVGVISEDKIQGKVELAAPLGILAGIVPTTNPTSTTIFKSMLTAKTRNTIIFAFHPQAQKASVLAAKIVYDAAVKAGAPENFIQWIEKPSLYATSALIQNPHIASILATGGPSMVNAALKSGNPSMGVGAGNGAVYIDATVDTDRAVSDLLLSKRFDNGMICATENSAVIQAPIYDEILTKLQEQGAYLVPKKDYKKIADYVFKPNAEGFGIAGPVAGMSGRWIAEQAGVKIPDGKDVLLFELDQKNIGEALSSEKLSPLLSIYKVEKREEAIETVQSLLNYQGAGHNAAIQIGSQDDPFIKEYADAIGASRILVNQPDSIGGVGDIYTDAMRPSLTLGTGSWGKNSLSHNLSTYDLLNIKTVARRRNRPQWVRLPKEVYYEANAITYLQDLPTINRAFIVADPGMVQFGFVGRVLGQLELRQEQVETNIYGSVKPDPTLSQAVEIARQMADFKPDTVILLGGGSALDAGKIGRFLYEYSTRHEGILEDDEAIKDLFLELQQKFMDIRKRIVKFYHARLTQMVAIPTTSGTGSEVTPFAVITDDETHVKYPLADYELTPEVAIVDPEFVMTVPQHTVSWSGLDALSHALESYVSVMASEFTRPWALQAIKLIFDNLTNSYNYDPKHPTKEGQNARTKMHYASTLAGMSFANAFLGLNHSLAHKTGGEFGLPHGMAIAIAMPHVIKFNAVTGNVKRTPYPRYETYTAQKDYADIARYLGLKGETDAELVDVLIAEIKKLAASVGVNQTLSGNGVSKHDFDTKLEKMIDLVYNDQCTPGNPRQPSLAEIRQLLKDQF

SEQ ID NO: 73 - DNA, 927 bp, Streptococcus thermophilus
  CDS (1)..(927): Streptococcus thermophilus CNRZ1066; gene str0936 encoding alcohol dehydrogenase
  tRNA (1)..(3): Met inserted by tRNA at start codon (GTG) instead of Val
gtggatctgacctttggagttaccgtaatccggaaatggaagagggacatagaaaatagtggtcatgaggctatcggaattgtcgaagaagttggtgagcaagttactacggtaaaaccaggagactttgtcattgcacctttcacacatgggtgtggtcagtgtgatgcttgtcgagctggttttgacggctcttgtgataaccactcaggtaataactggtctgagggcgtgcaggctgagtatatccgtttccactttgccaactgggcccttgtcaaaattcttgggcaaccctcagattatagcgaaggcatgctcaagtcacttttgacacttgctgatgttatgccgacgggttaccatgctgcgcgtgtggctaatgtacaaaagggtgataaggttgtcgttatcggagatggggctgttggtcaatgtgctgtcattgcatctaagatgcgtggagcttctcaaattgtccttatgagccgtcacgaagatcgtcaaaagatggctttggagtcaggtgcgactgcggttgtagctgagcgtggcgaaaaaggcattgacaaagtccgtgaagtcctcgggggaggagcagatgcagctctcgaatgtgtcggtactgaagcagcagtagaacaagctcttggtgtcctccataacggtggtcgtatgggatttgtcggtgtgcctcattataataaccgttcccttggttcgacctttgcccaaaatattttagtggcgggaggggtagcctctgtcacaacctatgataaacaagttttgttaaaagctgttcttgatggcgacatcaatccaggccgagtctttacgacaagttataaattggaagatattaatcaggcttataaagatatggatgaacgcaagtctattaaatctatgattgttttagattag

SEQ ID NO: 74 - protein, 308 aa, Streptococcus thermophilus
VDLTFGVTVIRKWKRDIENSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 75 - DNA, 2697 bp, Oenococcus oeni
  CDS (1)..(2697): Oenococcus oeni PSU-1; gene OEOE_1248 encoding alcohol dehydrogenase
atggcagttgaaacgaagaagattactaaaaagatactgacttccgacgaacttaaagacaaaaaggagacagcaaaaaaatacattggagaattagtcgataaatcaagacaggcattattagaattctctcaatatagtcaatcacaagttgacaaaattgttgccgcaatggctttagccggttccgaacattctttggaattagcacactttgctcgaaatgaaactggaagaggagttgttgaagacaaagatacgaaaaatcgttttgcctcggaatctgtatataacacgattaaaaatgacaaaacagttggcgtaattgatgaagacccaatcactggcaaagttcagttagctgcaccacttgggattttagccggaattgttccaacgacaaatccaacgtctaccacgatttttaaatcattgttaaccgctaagacacgtaatacgatcatttttgcttttcacccgcaagcacaaaaatcgtctgtagcggctgcgaaaattgtttaccaggcggctagaaaagctggagcaccgaaagatttcattcagtggatcgaaacgccttccttggaaaatacgactgctttgatgcaaaatcctgaaatagcttcaattttggctactggaggcccttctatggttcatgccgcattaacatcgggaaacccttcaatgggtgttggggcaggaaatggagctgttttcattgaccatacggctcgtgttcgtcgagcggcagaagacttgttgctatcaaaacgttttgataatggaatgatttgcgctacagagaattccgcagttatcgaagcttcggtttatgacgaatttatgaaattaatgcaggaaaagggtacttatctcgttccgaaggatgattacaaaaagatcgctgattttgttttcagcgataaacatgcagttaatggtccggttgccgggatgagtggccgttggattgctgaacatgccggtgttactttgccgaagggcaaagatgttttgttgtttgagttggatcaagacgacattggcgaaaaactttcctcggaaaaacttagccccttgctttcggtctataaagctgctgatcgtaaagaagcgataaaagttgttcaaagacttttgaactatcaaggagctggtcataatgcggcaatccagattggcgctcaagacgatccctttgttaaagaatatgccgatgcagtttctgcatctagaattttggttaaccagcccgattcaataggtggagtcggcgatatttatacagatgcattgcgtccaagtatgacgcttggtactggttcatgggggaagaattcattgtcacataatttatcaacttacgatttgttgaatgtcaaaacggttgcccgcagacgtaatcgtcctcaatgggttcgtcttccaaaagatatctactatgagaaaaatgccattacctatctgcaggaattaccgaacgtcaatcgggctttcgttattaccgatcattcgttggtcaaatatggattcgtcgatcggattcttgagcaattcgaattgcgtcccgaccaggttaaaacaagtatttacagttctgttcaaccggatccttatttgagtcaggctgttgaaattgcaaaacaaatgcaggagttcgaaccggatacagtaattgctcttggaggaggttcctctttggatgttgccaagatttcccgttttctttatgaatattctcaagaaccggaccacattggttttttggaaaacattgacgatattaaagaattgtttaaaggattgcagcaaaagtttatggatattcggaaacggattgttaaattcgaacatcagaatttgactcaactggttgctattccaacaacttcgggtaccggttcggaagtaacaccgttttcggttatcaccgatgatgaaactcacgttaaataccctttggccgattatgaattaactccgcaagttgcaatcgttgatcctgaattggttatgactgtaccaaaacggaccctggcttggtctggactggacgccttatctcactcgcttgaatcctacgtgtcggttatgagttctgaatttacacggccgtgggctttacaggcaatcaaactgatttttgaaaacatcgttgattcctataattacgatccaaagcacccaactaatcggggcgccgaggcacgtgaaaaaatgcattatgctgcaactttggccggcatgtctttcggaaacgccttcttgggtataaaccattcactggcccataaaaccggtggagagttcggtcttcctcatggtttggcaatcagcatcgcgatgccacatgtaattcgatttaatgcggttaccggaaacgtcaaacggactccttttcctcgttatgaggtttatacagcccaaaaagattatgccgatattgcgcgccatattggcctcagcggtaagaacgatgccgaattggttgaaaaacttatcgccaaaatcaaggaattaaccgatgccttggatgtcaatattactttgagcggcaatggagtcgataaaaagagctttgaacattctttggatcaactggttgatcttgtttacgatgaccagtgcacgccaggaaatccgcgacaaccgaatttagctgaaattaggcagttattgatcgaccaattttaa

SEQ ID NO: 76 - protein, 898 aa, Oenococcus oeni
MAVETKKITKKILTSDELKDKKETAKKYIGELVDKSRQALLEFSQYSQSQVDKIVAAMALAGSEHSLELAHFARNETGRGVVEDKDTKNRFASESVYNTIKNDKTVGVIDEDPITGKVQLAAPLGILAGIVPTTNPTSTTIFKSLLTAKTRNTIIFAFHPQAQKSSVAAAKIVYQAARKAGAPKDFIQWIETPSLENTTALMQNPEIASILATGGPSMVHAALTSGNPSMGVGAGNGAVFIDHTARVRRAAEDLLLSKRFDNGMICATENSAVIEASVYDEFMKLMQEKGTYLVPKDDYKKIADFVFSDKHAVNGPVAGMSGRWIAEHAGVTLPKGKDVLLFELDQDDIGEKLSSEKLSPLLSVYKAADRKEAIKVVQRLLNYQGAGHNAAIQIGAQDDPFVKEYADAVSASRILVNQPDSIGGVGDIYTDALRPSMTLGTGSWGKNSLSHNLSTYDLLNVKTVARRRNRPQWVRLPKDIYYEKNAITYLQELPNVNRAFVITDHSLVKYGFVDRILEQFELRPDQVKTSIYSSVQPDPYLSQAVEIAKQMQEFEPDTVIALGGGSSLDVAKISRFLYEYSQEPDHIGFLENIDDIKELFKGLQQKFMDIRKRIVKFEHQNLTQLVAIPTTSGTGSEVTPFSVITDDETHVKYPLADYELTPQVAIVDPELVMTVPKRTLAWSGLDALSHSLESYVSVMSSEFTRPWALQAIKLIFENIVDSYNYDPKHPTNRGAEAREKMHYAATLAGMSFGNAFLGINHSLAHKTGGEFGLPHGLAISIAMPHVIRFNAVTGNVKRTPFPRYEVYTAQKDYADIARHIGLSGKNDAELVEKLIAKIKELTDALDVNITLSGNGVDKKSFEHSLDQLVDLVYDDQCTPGNPRQPNLAEIRQLLIDQF

SEQ ID NO: 77 - DNA, 2613 bp, Bacillus coagulans
  CDS (1)..(2613): Bacillus coagulans 36D1; gene Bcoa_0619 encoding alcohol dehydrogenase
atggcaatcgatgaaaaagttgttggcaaatctgcgcaaatcacggaaatggtcgattccctcgtcgcaaaagggcaaaaagcactgcgtgaatttatggaactggatcaggcacaagtggacaatatcgtaaaacaaatggcacttgccgggttggaacagcatatggtgctcgccaaaatggccgtggaagaaacagggcgcggcgtatatgaagacaaaatgacaaaaaacttgtttgcaacagaatacatctatcacaacattaaatataacaaaacagtcggcatcattgacgaaaacaataatgaagggattgttaaatttgcggaaccggtcggcgtgattgccggggtcactcctgtaacaaacccgacatcaaccacgatgtttaaagcattaattgccattaaaacacgcaacccaattattttcgcgttccatccgtccgcacaaaaatgcagcagccatgccgcaaaagtgatgcttgacgctgctgtgaaagccggcgccccggaaaactgcatccaatggatcgaaaaaccggccattgaagcgacacagcaattgatgaaccattcgggtatttcactgattcttgcaacgggcggttccggcatggtaaagtccgcatattcgagcgggaaacctgcgcttggcgtcgggccgggaaacgtcccttgctatattgaaaaatctgctgatatcaaacgcgccgtcaatgatttgattttgtccaaaacgtttgacaacggcatgatctgtgcgtcggaacaggctgtcatcatcgacaaagaaatttatgacaatgtgaaaaacgaattgattgcaaatcaatgctacttcctgaatgaagcggagaagaaaaaggttgagaaaaccgtcatcaatgaaaagacgcaatccgtcaacagcgccattgtcggcaaaccggcctatgaaattgcgaaaatggcaggcgtaaatgttccggaagataccaaaattttaatcgccgaacttacaggtgtcggcccggactacccgctttccagagaaaaattaagcccggttttggcctgttacaaagccaacagcacaaaacaaggtttcgaatttgcagaagccatgctcgaattcggcggacttggtcactcggctgtgatccattcgacaaacgatgaagtcattgaacaatacggcttaaaaatgaaagccggccggatcattgtcaactccccgtcttcgcaaggggcaatcggcgacatttacaatgcctacatgccttctttgacactcggctgcggcacgtttggcggcaactcggtgtccacaaacgtcggtgtcatcaatctttacaatgtaaaaacaatggcgaaacggagagtcaatatgcaatggtttaaaattccaccgcgcgtgtattttgaaaagaactcggtccaatacctggaaaaaatgccggatatctcaagtgcctttattgtcaccgatccggatatggtcaggcttggattcgttgagaaagtactgtattacttgcggaaacgcccggactatgtgcactgtgaaattttctcagaagtcgaaccggatccgtctattgaaacggttcggaaaggtgccgcagctatggcaagcttccagccggatgtcattatcgcgcttggcggcgggtcggcgatggatgctgcaaaaggcatgtggctgttctatgagcatccggaagttgatttcaacgaattgaagcaaaaatttatggacatccggaaacgggttgccaaattcccgaaactgggtgaaaaagcgcagctggtctgcattccgaccacatcgggcaccggttctgaagtgacttctttcgccgtcatttcggataaaaagaacaacacaaaatatccgctcgcagactatgaactgacaccggatgttgcgatcattgacccgcagtttgttatgaccgttccgaaatccgtaacagccgataccgggatggacgttttgacccatgcgattgaagcctatgtatccaacatggccaacgactatacggacggcctggcaattaaggccatccagcttgttcacgaatacttgccgaaagcatacgcaaatggcaatgatgcactggcacgcgaaaaaatgcacaatgcatcgactttggcagggatggcgttctcgaatgcattccttggcatcaaccattcacttgcccataaaatcggcgctgaattccatattccgcacggccgggctaacgcgattctgttgccgcatgtcatccgctataacgcgcaaaagccgaaaaaatttgcggcattcccgaaatacgaacattttattgcggatcaacgctacgcggaaatcgcgcgcgtacttggtcttccggcaagcacgacagaagaaggtgtcgaaagcctttgccaggaaatcatccggatgtgcaaactgttcaatattccgcttagcctaaaagcagccggcgtgaaccgggcggactttgaaaaacgggttgccattattgcagaccgcgcatttgaagaccaatgcacacctgcaaaccctaaattgccgcttgtcagcgaattggaagacattttacgcaaagcttttgaaggcgttgaagcaaaataa

SEQ ID NO: 78 - protein, 870 aa, Bacillus coagulans
MAIDEKVVGKSAQITEMVDSLVAKGQKALREFMELDQAQVDNIVKQMALAGLEQHMVLAKMAVEETGRGVYEDKMTKNLFATEYIYHNIKYNKTVGIIDENNNEGIVKFAEPVGVIAGVTPVTNPTSTTMFKALIAIKTRNPIIFAFHPSAQKCSSHAAKVMLDAAVKAGAPENCIQWIEKPAIEATQQLMNHSGISLILATGGSGMVKSAYSSGKPALGVGPGNVPCYIEKSADIKRAVNDLILSKTFDNGMICASEQAVIIDKEIYDNVKNELIANQCYFLNEAEKKKVEKTVINEKTQSVNSAIVGKPAYEIAKMAGVNVPEDTKILIAELTGVGPDYPLSREKLSPVLACYKANSTKQGFEFAEAMLEFGGLGHSAVIHSTNDEVIEQYGLKMKAGRIIVNSPSSQGAIGDIYNAYMPSLTLGCGTFGGNSVSTNVGVINLYNVKTMAKRRVNMQWFKIPPRVYFEKNSVQYLEKMPDISSAFIVTDPDMVRLGFVEKVLYYLRKRPDYVHCEIFSEVEPDPSIETVRKGAAAMASFQPDVIIALGGGSAMDAAKGMWLFYEHPEVDFNELKQKFMDIRKRVAKFPKLGEKAQLVCIPTTSGTGSEVTSFAVISDKKNNTKYPLADYELTPDVAIIDPQFVMTVPKSVTADTGMDVLTHAIEAYVSNMANDYTDGLAIKAIQLVHEYLPKAYANGNDALAREKMHNASTLAGMAFSNAFLGINHSLAHKIGAEFHIPHGRANAILLPHVIRYNAQKPKKFAAFPKYEHFIADQRYAEIARVLGLPASTTEEGVESLCQEIIRMCKLFNIPLSLKAAGVNRADFEKRVAIIADRAFEDQCTPANPKLPLVSELEDILRKAFEGVEAK

SEQ ID NO: 79 - DNA, 711 bp, Lactococcus lactis
  CDS (1)..(711): Lactococcus lactis subsp. cremoris MG1363; gene llmg_1275 encoding a-acetolactate decarboxylase
atgtcagaaatcacacaactttttcaatataatacccttggggcattaatggccggactttatgaggggacaatgacgattggtgagctcttgaaacatggtgacttaggaattggaactttagattcaattgatggtgaattgattgttttagatggtaaagcttatcaagctaagggagataaaacgatcgtcgaattaactgacgatatcaaagttccttatgctgcagttgttcctcatcaggcagaagttgttttcaaacaaaaatttacagtaagcgataaagaattggaagaccgaattgaaagctattttgatggtcaaaacttattccgctcaatcaaaattactggtaaatttccaaaaatgcatgtacgaatgattccgcgtgctaaatcaggaacaaaatttgtagaagtttcacaaaaccaaccagaatataccgaagaaaatatcaaaggaacaattgttggaatttggactcctgaaatgttccatggtgtcagcgttgctggttatcatcttcattttattagtgaagatttcacttttggtggacatgttcttgattttattattgataatgggactgttgaaattggagcaattgaccaattgaatcaatcattccctgttcaagatcgcaaatttttatttgccgaccttgacattgaggctttgaaaaaagatattgatgtagctgaatga

SEQ ID NO: 80 - protein, 236 aa, Lactococcus lactis
MSEITQLFQYNTLGALMAGLYEGTMTIGELLKHGDLGIGTLDSIDGELIVLDGKAYQAKGDKTIVELTDDIKVPYAAVVPHQAEVVFKQKFTVSDKELEDRIESYFDGQNLFRSIKITGKFPKMHVRMIPRAKSGTKFVEVSQNQPEYTEENIKGTIVGIWTPEMFHGVSVAGYHLHFISEDFTFGGHVLDFIIDNGTVEIGAIDQLNQSFPVQDRKFLFADLDIEALKKDIDVAE

SEQ ID NO: 81 - DNA, 711 bp, Lactobacillus casei
  CDS (1)..(711): Lactobacillus casei ATCC 334; gene LSEI_1840 encoding a-acetolactate decarboxylase
  misc_feature (1)..(3): Met inserted by tRNA at start codon (GTG) instead of Val
gtgaatactgatcggttatatcaacatggcacattggcaatgcttgtacccggattgtttgctggtacgcaaaagattgaagaactgctgcagcatggcaatactggtattggcactttgacggcgctagatggcgaacttgtgatcattgatagcaaagtttatcaagtcaatgcacaaggcgctgttcgcgaagtcgggtcagaagaagaagtaccgtttgcaaacgtgcattatcaagctgataaatctgtaggcaaactacaaggacttgatttgtcaggctttcaaaaaacggttttggaacgccttcaaacggccaatctttttgctgcagtacgcgttgaggggcggtttacgcagatgcatacacgcgcggtgttgccacaacagccaccgtatccaacgcttactgaaacagcttcaggtcaaaaagaattcaacgctgagaatatcaagggtacattgattgggtattattcgcctgatctctatgcgggtgcggtgtcaccggggttccacttgcattttcttgacgctgatcatcacatgggtggccatattcttggcttcgaactcgacagtggcgaattgtttctgcaaaagtttagtgacttccagctacatctgccgacaaccaacgatgcttttttaaagcaaaaatttgacacggcaacactggtagccgatattcgcaaggctgagaattga

SEQ ID NO: 82 - protein, 236 aa, Lactobacillus casei
VNTDRLYQHGTLAMLVPGLFAGTQKIEELLQHGNTGIGTLTALDGELVIIDSKVYQVNAQGAVREVGSEEEVPFANVHYQADKSVGKLQGLDLSGFQKTVLERLQTANLFAAVRVEGRFTQMHTRAVLPQQPPYPTLTETASGQKEFNAENIKGTLIGYYSPDLYAGAVSPGFHLHFLDADHHMGGHILGFELDSGELFLQKFSDFQLHLPTTNDAFLKQKFDTATLVADIRKAEN

SEQ ID NO: 83 - DNA, 711 bp, Lactobacillus plantarum
  CDS (1)..(711): Lactobacillus plantarum WCFS1; gene lp_2030 encoding a-acetolactate decarboxylase
atggacacaacaacaatttttcaacacggcacattaggcttacttgttcccggcttatttgacgggacgattacggctggtgaactcttaacccatggtgatacgggtattgggacgttagacggtctcaatggtgaagtgattattctaggaggtcacgcctatcaagcacgtgaggatggtcaaattcgtgaaattcagcccgaagagacgttaccatttgcatcggtgcactttgaaaagcctgatattagtgcgcaattagctgcaatcacacaaactgattttgagcaacaagtggttcatgactatcgtttgaccaacgtgtttgcagctattcgcgtcgatgggacctttgcaaaagtcaagacgcgagtcgcgcctcgtcaggaaccaccgtacaaaacattagtcgcggcaacggcaacacaaccggaattcaccggtgaacatgttgacggaacgattattggctactacgcaccgcatttgttccaaggcgctacggtcggtggctttcacttacactttctaagtaaagaccatcaattaggtggacacttgctggggtttgaagtcgaacaagcgacgctgaaagttcaacattttgctgactttcatgtgcacttgccaatcgacaatgaagcgtacttacaagaacaatttgataatgaagccattgatcatgccattaataaagctgagcgttga

SEQ ID NO: 84 - protein, 236 aa, Lactobacillus plantarum
MDTTTIFQHGTLGLLVPGLFDGTITAGELLTHGDTGIGTLDGLNGEVIILGGHAYQAREDGQIREIQPEETLPFASVHFEKPDISAQLAAITQTDFEQQVVHDYRLTNVFAAIRVDGTFAKVKTRVAPRQEPPYKTLVAATATQPEFTGEHVDGTIIGYYAPHLFQGATVGGFHLHFLSKDHQLGGHLLGFEVEQATLKVQHFADFHVHLPIDNEAYLQEQFDNEAIDHAINKAER

SEQ ID NO: 85 - DNA, 705 bp, Pediococcus pentosaceus
  CDS (1)..(705): Pediococcus pentosaceus ATCC 25745; gene PEPE_0406 encoding a-acetolactate decarboxylase
atggcaaaattatttcaacatgggacgctcgcaatgctagtagatggactttttggtgggacgcttgcggtttccgatttactgaagcacggtgactttggaatcggaactgctgaaggccttaatggcgaattaattattttagatggagccccttaccaagcgctagcagacggtacaattagggttattggtgatgatgaactattaccgtttgctaacgttaattcagcggattttgaaggacgagcagtgttatctgacattgagatgaaagatgtggatgcgacacttgctaaagaattgtcatatcaaaatacatttgttgctattaaaattagtggaactttccgtacagttcaaactcgggtggtaaagcaacaagaacgtccttatccaacccttagtgaaacagcatctaaacaacaagtttttaatgctgaagatgttagaggaacagtagttggctactacaccccagatcttttccatggtgcgggagtagcggggatgcatcttcattttattgacgatcaacacgaattcggaggtcatttactagactttaaggcggatcaagttaaactttcttggcaactattagacggtttagacctcaatttaccaattcaagacgcagaatttatggcacatgaggctagcgacgcggaaaaaattcaacaatcaatttctgagtctgaataa

SEQ ID NO: 86 - protein, 234 aa, Pediococcus pentosaceus
MAKLFQHGTLAMLVDGLFGGTLAVSDLLKHGDFGIGTAEGLNGELIILDGAPYQALADGTIRVIGDDELLPFANVNSADFEGRAVLSDIEMKDVDATLAKELSYQNTFVAIKISGTFRTVQTRVVKQQERPYPTLSETASKQQVFNAEDVRGTVVGYYTPDLFHGAGVAGMHLHFIDDQHEFGGHLLDFKADQVKLSWQLLDGLDLNLPIQDAEFMAHEASDAEKIQQSISESE

SEQ ID NO: 87 - DNA, 720 bp, Leuconostoc mesenteroides
  CDS (1)..(720): Leuconostoc mesenteroides subsp. mesenteroides ATCC 8293; gene LEUM_0549 encoding  a-acetolactate decarboxylase
atgacaacaatatatcaacatggtacattagcacaattagtagcgcgccaaatgtcagggacaataacagtcgctgaaatgttggaacatggggacactggcattggtacttttgagggcctcaatggtgaagctatttttctaaacggggaagcctatcaagctgatagtacaggaaaagttcaccacattactgataaacaaactacattaccttttgcatcaatccattttgatcaaccggaggcaagccaaaaattaccttttaaaaaaataaaatatagtaatttgactcagaacttgaaagatgagcagttatttaacgttttctctgccttaaaactgcatggtgagtttgcccacgttcacgttcgtattgtaacaaaacaagagaagccatatccaagtttgttacaagtagctgaacagcagcctgaattcaaagcagacaacataactggtacattagttggatattatgcaccaaaagtttttggcggtccaaccgcagcagggtggcatttacactttttgtcagatgatttaacctttgctgggcacgttttggattttgaagcaacagatgtcgatggtactttagaagtttttgataactttttgcaacatctacctattaataatgctgactttagaagcatgaatcaggatatagctggtttggataaagccattgaggccagtgaaggcggaaaaaattag

SEQ ID NO: 88 - protein, 239 aa, Leuconostoc mesenteroides
MTTIYQHGTLAQLVARQMSGTITVAEMLEHGDTGIGTFEGLNGEAIFLNGEAYQADSTGKVHHITDKQTTLPFASIHFDQPEASQKLPFKKIKYSNLTQNLKDEQLFNVFSALKLHGEFAHVHVRIVTKQEKPYPSLLQVAEQQPEFKADNITGTLVGYYAPKVFGGPTAAGWHLHFLSDDLTFAGHVLDFEATDVDGTLEVFDNFLQHLPINNADFRSMNQDIAGLDKAIEASEGGKN

SEQ ID NO: 89 - DNA, 711 bp, Leuconostoc mesenteroides
  CDS (1)..(711): Leuconostoc mesenteroides subsp. mesenteroides ATCC 8293; gene LEUM_0954 encoding a-acetolactate decarboxylase
atgtctacaatttatcaacatggaacgttagaattaattatgtcaggattatatgacggtacggcaccgttgtcgtcaatattgaatcatggttcgagtggcattggaacaatggatgaacttgatggtgaagttacaatcatagaaaatagcgtatatcaaacgaaagcgaatggtgtaactaaaggaatcacagatttatcgttggaaacaccttttacttccatccattctcaatcagagttatactattttcttcaagaaaaatttttaacttttgatagtttaaacaatatatccaaacaacatcagagctgggctaatttaccagctagtattcaaataaatgctagtttttcgaaactgaaggttcgtgttgctcctaagcaaatgaagccttatccacccttcgttgatgtaacattgaaacaaccagtgtttaattatgaaaatgtttctggtactttaattggtgattttggtcctgacctttattctggcattatggcgagtgggtggcatcttcattttttaagtgatgatcgtacgattggcggccatgttcttgatttcaaggcgagcgatgtattaggtagaattgatttattcaatgaactcaacatcgctttgcctactgataatcctgatttcaataatcatgaagccgacatattgaatattcgtgaagccatcgatgtagcagaaagataa

SEQ ID NO: 90 - protein, 236 aa, Leuconostoc mesenteroides
MSTIYQHGTLELIMSGLYDGTAPLSSILNHGSSGIGTMDELDGEVTIIENSVYQTKANGVTKGITDLSLETPFTSIHSQSELYYFLQEKFLTFDSLNNISKQHQSWANLPASIQINASFSKLKVRVAPKQMKPYPPFVDVTLKQPVFNYENVSGTLIGDFGPDLYSGIMASGWHLHFLSDDRTIGGHVLDFKASDVLGRIDLFNELNIALPTDNPDFNNHEADILNIREAIDVAER

SEQ ID NO: 91 - DNA, 720 bp, Streptococcus thermophilus
  CDS (1)..(720): Streptococcus thermophilus CNRZ1066; gene str0924 encoding a-acetolactate decarboxylase
atgtctgaagccataaaattatttcaatataatactttgggagccttgatggctgggctttatggaggtactttaaccgttggagagttgttagagcatggagacttgggtctcggaacattagattctatcgatggtgagttgattgttcttgacggtaaagcctatcaagctaaaggctctgaaggtaaagtcgaagtggtagaagtttctcctgatgaaaaagttccctatgcagcagtcgtacctcaccaagctgaagttatcttccgtcaacgttatgaaatgactgataaagaacttgaggatcgtattgaatcatactatgatggggtcaatcttttccgttcaatcaaaatcaaaggtcattttaaacacatgcacgtgcgcatgattccaaaatcaaatgcggacattaagtttgctgatgttgccactcgccaacctgagtatgaggtagatgatatttcaggtacaatcgttggtatctggacacctgaaatgttccacggtgtgagtgttgctggttaccatctccattttatttcagatgacttgacattcggtggtcacgttatggattttgttatcgagaatggtattattgaagttggaccagttgaccaactcgatcaacgcttcccagttcaagaccgtcaatatctctttgctaaattcaatgttgatgaaatgcgtaaagatattactaaggctgaataa

SEQ ID NO: 92 - protein, 239 aa, Streptococcus thermophilus
MSEAIKLFQYNTLGALMAGLYGGTLTVGELLEHGDLGLGTLDSIDGELIVLDGKAYQAKGSEGKVEVVEVSPDEKVPYAAVVPHQAEVIFRQRYEMTDKELEDRIESYYDGVNLFRSIKIKGHFKHMHVRMIPKSNADIKFADVATRQPEYEVDDISGTIVGIWTPEMFHGVSVAGYHLHFISDDLTFGGHVMDFVIENGIIEVGPVDQLDQRFPVQDRQYLFAKFNVDEMRKDITKAE

SEQ ID NO: 93 - DNA, 717 bp, Oenococcus oeni
  CDS (1)..(717): Oenococcus oeni PSU-1; gene OEOE_1704 encoding a-acetolactate decarboxylase
atgaaagatttaacaaaagcttatcaacatggcactttggctcaaattatggatggccaatatgatgggacaatactgcttaaagatcttctcgaacacggcgatttcggtattggtacaacaaccggaatcggggtcgaattaatagttttggatggggtggcttatggaatccccagcagcggaaaagtccaaaaaatggacatcgagcacgaaaaagcaccctttgcaaatattaactacttcgatcaaaagttgaagagcgaaagcctaattaatcttgattccgatagttttcaaaaaagggttgaagaagaatataaacttaaaaatgtctttgccgcaattagagtacacggagaatttacaaatgttttggcgcgatcagccgataaacaagaaaaaccatacccgccattttcaaaggtcgcggcagcgcaacatgaattccatgctgattcactgacggcaacgatggttggctattattcagcagcgatgtatgaagggacaaccgcggccggctttcaccttcacattctctccgatgatcgtcaattcggagggcacctattagattttaaaatcaaaaaagccgacctccaggttcagatttttcaggatttccagttgcatctaccaattgaaaatcccgattttcgccgacgcgaattagacttggaaactttaaaaaaagcgattgaaaagacagaataa

SEQ ID NO: 94 - protein, 238 aa, Oenococcus oeni
MKDLTKAYQHGTLAQIMDGQYDGTILLKDLLEHGDFGIGTTTGIGVELIVLDGVAYGIPSSGKVQKMDIEHEKAPFANINYFDQKLKSESLINLDSDSFQKRVEEEYKLKNVFAAIRVHGEFTNVLARSADKQEKPYPPFSKVAAAQHEFHADSLTATMVGYYSAAMYEGTTAAGFHLHILSDDRQFGGHLLDFKIKKADLQVQIFQDFQLHLPIENPDFRRRELDLETLKKAIEKTE

SEQ ID NO: 95 - DNA, 750 bp, Bacillus coagulans
  CDS (1)..(750): Bacillus coagulans 36D1; gene Bcoa_2135 encoding a-acetolactate decarboxylase
atgcgtactgctgcagaaaatcaaaatacagagcaaattttaacaagccggaccgatgaagtataccaattgtccacgatgacatcgcttcttgacggcgtatacgaaagcgacaagacgtttgctgaattaaaaaagttcggcgatttcggcatcggcactttcaaccatttggacggggaattgattgcctttgacaatgcgttctatcagctgaaggacgggacggcaaaacgtgtacagcctgaagacaagtcaccgttttgctcgcttgcacatttttcggaggatatcacctatacagctgaaggtcctctagcaaaacccgaactggaagacttgatcaaagatctcgtccgcagcgaaaatttattttatgccattcgtgtggacggtgtttttaaaaaaatgaacacaagaaccgtctcctaccaggaaaaaccggttcccatgacggaagcggtgaaatcccagccggtttactcgtttgaaaatacaaaaggaacgctttctggtttttggacgccgatgtttgcacaaggaatcgcggtcgccggcttccacctccattttattgacgacaaacgcaccggcggcggccatgtctttgactatgtgcttgactacgggacgatccggatcagcaaaaaaacgcatatgcatctggaacttccggaaacagacgcttttttaaatgcgaacctttcccgcgccaatttggcagaggaactggaaaagacagaaggctga

SEQ ID NO: 96 - protein, 249 aa, Bacillus coagulans
MRTAAENQNTEQILTSRTDEVYQLSTMTSLLDGVYESDKTFAELKKFGDFGIGTFNHLDGELIAFDNAFYQLKDGTAKRVQPEDKSPFCSLAHFSEDITYTAEGPLAKPELEDLIKDLVRSENLFYAIRVDGVFKKMNTRTVSYQEKPVPMTEAVKSQPVYSFENTKGTLSGFWTPMFAQGIAVAGFHLHFIDDKRTGGGHVFDYVLDYGTIRISKKTHMHLELPETDAFLNANLSRANLAEELEKTEG

SEQ ID NO: 97 - DNA, 771 bp, Lactococcus lactis
  CDS (1)..(771): Lactococcus lactis subsp. cremoris MG1363; gene llmg_0339 encoding a diacetyl reductase
atggggaaattagcgattgtaacgggaagcggacaaggtattggggaaggtattgtctatcggttagcaaaagatggatttgcggttgccgtagcagatattaatcctcaaacagcaaaaaatgttgcaaaaactttgatagataaaggatttgaagctaaagcttacgtgcttgatgttgcgaaccgttcggcagtttttcagcttattgaacaagcggtgagtgattttggtgaacttgctgtatttgttaataatgctggggttgcttttattgatagcattatagattctgattcagaaagggttgaacgactatttgatgtcaatatcaaaggtacttattggggaatacaagcagcagctacccaatttaaaaaacaaggtcatggcggacgaattatcaatgcggcttcgcttgcaagtgttgaaggttctgccttgcaaagtgcttattctgcttcaaaatttgcaatacgtggattgacacagtcggcagcgaaagaacttgcaaaagactatatcacagtgaatgcttataatcctggaattgtacgcaccgctatgcgagatgagattgataaaaaaacggctcaaatcaaaggaattagcattgaacagcaacaacagaattgtttgaatgaaatctacctcggacgtgaaggaagaccagaagatgttgcagaagttgtggcctggtttgcttcagatgcagcagaatatattacaggacaatctatcttagtggatggcgggatgagattcaattag

SEQ ID NO: 98 - protein, 256 aa, Lactococcus lactis
MGKLAIVTGSGQGIGEGIVYRLAKDGFAVAVADINPQTAKNVAKTLIDKGFEAKAYVLDVANRSAVFQLIEQAVSDFGELAVFVNNAGVAFIDSIIDSDSERVERLFDVNIKGTYWGIQAAATQFKKQGHGGRIINAASLASVEGSALQSAYSASKFAIRGLTQSAAKELAKDYITVNAYNPGIVRTAMRDEIDKKTAQIKGISIEQQQQNCLNEIYLGREGRPEDVAEVVAWFASDAAEYITGQSILVDGGMRFN

SEQ ID NO: 99 - DNA, 762 bp, Lactococcus lactis
  CDS (1)..(762): Lactococcus lactis subsp. cremoris MG1363; gene llmg_1641 encoding acetoin reductase
atgtctaaagttgcagcagttactggcgcaggtcaaggaattggctttgctatcgcaaaacgtttatataatgatgggtttaaagtcgcaatcattgattacaatgaagaaacagctcaacaagcagctaaggaacttggtggcgaatcatttgctcttaaagcagatgtttctgaccgtgaccaagtagttgccgctttagaagctgttgttgaaaaatttggtgatttgaatgtagtagtaaataatgcaggaatcgccccaaccactccgattgaaacaattactcctgaacaatttcatcaagtttataatattaatgttggtggagttttgtggggaacacaggcagccacagcacttttccgtaaactaggtcatggtggtaagattattaatgcaacttcgcaagcaggtgtcgtagggaatcctaacctaatgctttattcttcttcaaaattcgctgttcgtggaatgacacaaattgccgctcgcgatctagcagaagaaggaattacagttaatgcctatgcaccagggattgttaaaacaccaatgatgtttgatattgcacatcaagtgggtaaaaatgcaggtaaagatgacgaatggggcatgcagacttttgccaaagatatcgcgatgaaacgtttgtcagagcctgaggacgtggccaatgtggtttctttccttgctggtcctgattctaattatattacgggtcaaacaattattgttgatggtggaatgcaatttcattaa

SEQ ID NO: 100 - protein, 253 aa, Lactococcus lactis
MSKVAAVTGAGQGIGFAIAKRLYNDGFKVAIIDYNEETAQQAAKELGGESFALKADVSDRDQVVAALEAVVEKFGDLNVVVNNAGIAPTTPIETITPEQFHQVYNINVGGVLWGTQAATALFRKLGHGGKIINATSQAGVVGNPNLMLYSSSKFAVRGMTQIAARDLAEEGITVNAYAPGIVKTPMMFDIAHQVGKNAGKDDEWGMQTFAKDIAMKRLSEPEDVANVVSFLAGPDSNYITGQTIIVDGGMQFH

SEQ ID NO: 101 - DNA, 780 bp, Pediococcus pentosaceus
  CDS (1)..(780): Pediococcus pentosaceus ATCC 25745; gene PEPE_0286 encoding acetoin reductase
atggcaaacaaaaccaaagttgcattagtaacgggagcaggacaaggaattggggcagcaattgcgacccgattggctaacgatggatttgcggtggcagtggcagatatgaatactgaaactgctaacaaagttgctgaaaaaattaatagcaatggtggaagggctcttccaatcgtggttaatgtagcagaacgtgataatgtgtttgaagccgttaggactacgattcaggaactaggtggacttgatgtgttggtcaataatgccggcctaggacctaccacaccaattgatacaattacaccagaacaatttgataaagtttatcacgttaatgtaggtggagtactttggggaattcaagcagcaacggaagcatttaagaaattaggacatggtggaaaaatcatcaatgcgacttctcaagccggagttgttggaaaccctaatttggccctttactcagggactaagtttgctgtccgaggaattactcaagtagcagcacgtgatttggcggattttggtattacagttaatgcttatgcaccgggaattgtacgaactccgatgatgatggatatcgcacatgaagttggacaaaatgctggtaaagatgacgaatggggtatgcaacagtttgctaaagacattaccttaaaacgtttgtcagaaccagaagatgtggcagctgcagtatcattcttagcaggaccagattcaaattatgtaactggacaaacaattattgtagatggtggaatgcaatttcattaa

SEQ ID NO: 102 - protein, 259 aa, Pediococcus pentosaceus
MANKTKVALVTGAGQGIGAAIATRLANDGFAVAVADMNTETANKVAEKINSNGGRALPIVVNVAERDNVFEAVRTTIQELGGLDVLVNNAGLGPTTPIDTITPEQFDKVYHVNVGGVLWGIQAATEAFKKLGHGGKIINATSQAGVVGNPNLALYSGTKFAVRGITQVAARDLADFGITVNAYAPGIVRTPMMMDIAHEVGQNAGKDDEWGMQQFAKDITLKRLSEPEDVAAAVSFLAGPDSNYVTGQTIIVDGGMQFH

SEQ ID NO: 103 - DNA, 777 bp, Leuconostoc mesenteroides
  CDS (1)..(777): Leuconostoc mesenteroides subsp. mesenteroides ATCC 8293; gene LEUM_0117 encoding acetoin reductase
atgtcaaagaaagtagcaattattacaggcagtggtagaggaataggaaaagcaattgctgagagactcgcgacagaaaattattacgttgcagtagtcgacattgatgaatctagtgctaaatatgtgagtgatagtatcaacgctattaaggaaaaccaagccaaatattatgttttagatgttgctgatcgaaaatcagtttttgatttggttgataaagtagtagctgattttgggcgtctagatgtatttgttaataacgcagggattgcctacattgatagcattatcgatagtgatccggaaaaagttgagcggttgtttgatgttaaccttaagggcactttttggggaatccaggcggctgcaaaacagttgaaaaagcaagggagtggcggaaggataatcaatgctgcttcactggctgcagtggaaggatctgcactacaaggcgcatattcagcttccaaatttgccattagaggattaggtcaatctgcggcaaaagaactcgcaaaatataatatcactgtaaatacttatgatccgggtattgttattacacctttgcgcgattatattgatcagcgaacagcacaaattaaaaacacaacagctgagattcaaaggcaaagtgttgtcaatgaaattgcgttaggaagagcggctttgcctgatgatgtagccgatgttgtatcatttttggtttcacagcaggcaaagtatattactgggcaatcgattttaattgatggtggtatgagatttcattga

SEQ ID NO: 104 - protein, 258 aa, Leuconostoc mesenteroides
MSKKVAIITGSGRGIGKAIAERLATENYYVAVVDIDESSAKYVSDSINAIKENQAKYYVLDVADRKSVFDLVDKVVADFGRLDVFVNNAGIAYIDSIIDSDPEKVERLFDVNLKGTFWGIQAAAKQLKKQGSGGRIINAASLAAVEGSALQGAYSASKFAIRGLGQSAAKELAKYNITVNTYDPGIVITPLRDYIDQRTAQIKNTTAEIQRQSVVNEIALGRAALPDDVADVVSFLVSQQAKYITGQSILIDGGMRFH

SEQ ID NO: 105 - DNA, 777 bp, Leuconostoc mesenteroides
  CDS (1)..(777): Leuconostoc mesenteroides subsp. mesenteroides ATCC 8293; gene LEUM_0145 encoding acetoin reductase
atgtcagaaaataaagtcgctttggtaactggagctggtcaaggaattggacaggcaatcgcagaacgattgtcaaaagatgggtttaaggttgccttagttggacgtcatattgaaaaagtacaaaaagtagctgatgaaattaatgaaaatggtggtgaagccattgctattaaggctgatgtggctaaacgtgatgaagtttttgcagccgtcaaagaaacgaaagaaaagttcaatggttttgatgtgattgttaacaatgcgggtgttgcgcctacgacaccaatcatgtcagtaacggaagatgatatgaactggacatggggcattaatgttaatggtattgtctggggaacacaagctgcgacagaagccttcaaggaatttggtcatggtggcaaaatcattaatgcaacatcgcaagctggtgtgcaaggaaatgctaatttgactgcctatggatcaacaaaatttgccattcgcggtattacacaaacaacagctaaagagttagcagaatttggtattacagtaaatgcatttgcgcctggaattgtgaaaacaccgatgatggaagatattgctcatgaagtaagcgtgaacgctggtaaagacgacgaatggggaatggcacaattttcagaaggaatcaccttaggacgactaagtgaaccggaagatatagcaaatgtggtttccttcttgtctagctcagattcaaactatgtgacaggccaaacattaattgttgatggtggtatggtatttagttaa

SEQ ID NO: 106 - protein, 258 aa, Leuconostoc mesenteroides
MSENKVALVTGAGQGIGQAIAERLSKDGFKVALVGRHIEKVQKVADEINENGGEAIAIKADVAKRDEVFAAVKETKEKFNGFDVIVNNAGVAPTTPIMSVTEDDMNWTWGINVNGIVWGTQAATEAFKEFGHGGKIINATSQAGVQGNANLTAYGSTKFAIRGITQTTAKELAEFGITVNAFAPGIVKTPMMEDIAHEVSVNAGKDDEWGMAQFSEGITLGRLSEPEDIANVVSFLSSSDSNYVTGQTLIVDGGMVFS

SEQ ID NO: 107 - DNA, 780 bp, Oenococcus oeni
  CDS (1)..(780): Oenococcus oeni PSU-1; gene OEOE_0693 encoding acetoin reductase
atgtcaaataaagttgcaattattacgggagctggtcaaggaattggtaaagcaattgctcaaagactggcaaaagacggtttcaagacgggactgattggtagacatttagaaaaagtcgaagcagtggcaaaagaactaaatgaagaatatggttccgatactgctatagccaaaaaagccgatgtctcaaaacgcgacgaagtttttgcagcttttcaagaaataagcgacaatttcggagatttgaatgttgtcgtcaataacgctggcgttgctccaaccactccaattatggaagtcaccgaagacgatatggaatggacctggaaaatcaacgttgatggtgttgtatggggaattcaagcggctgcgaccatttttaagaaattcaatcacgctggaaaaatcatcaacgctacctcccaagccggagttcaaggcaatccagatttaaccgcttacggatcgacaaaatttgcgattcgtggaattactcaaacaactgccaaagagttggctaaatttggtattactgttaatgcttacgcacctggaattgtaaaaacaccaatgatggaagacattgcgcacgaagtcggcaagaatgccggaaaagacgacgactggggaatgaatcaatttgccaaaggaatcgccttgggtagaatttccgaaccggaagatgttgccaatgcagttggctttctagcaagttctgattcgaattatgttaccggtcaaacaatcgtcgttgatggaggtatggttttcaactaa

SEQ ID NO: 108 - protein, 259 aa, Oenococcus oeni
MSNKVAIITGAGQGIGKAIAQRLAKDGFKTGLIGRHLEKVEAVAKELNEEYGSDTAIAKKADVSKRDEVFAAFQEISDNFGDLNVVVNNAGVAPTTPIMEVTEDDMEWTWKINVDGVVWGIQAAATIFKKFNHAGKIINATSQAGVQGNPDLTAYGSTKFAIRGITQTTAKELAKFGITVNAYAPGIVKTPMMEDIAHEVGKNAGKDDDWGMNQFAKGIALGRISEPEDVANAVGFLASSDSNYVTGQTIVVDGGMVFN

SEQ ID NO: 109 - DNA, 774 bp, Oenococcus oeni
  CDS (1)..(774): Oenococcus oeni PSU-1; gene OEOE_1602 encoding acetoin reductase
atgacaaataaagtcgcaattgttaccggtggtggtcagggaattggccgtggaatcgctctgcgcctatcaaaagacggatattcagtgattattaatggaagaactcaggagaaactagacaaagttgctgaggagatcaaaaacaacaacggaaaggtgattacttttgttggagatgtctcaagcaagtctgctaacgagcagttagtaaaaaaagccgaatccgaatttggacgtttggacgtttttgtagccaacgctggaatcgattgggttgatactatcgagggaacaccggcagaccaagtagataatgtaataaatattaatttgaaatcgcaaatttgggccttgcaaacggcgccgaaagttatgcgaaaaagtggcgatggaggttcaatcgttttggcttcatcaattgccggcatggaaggtttcgagatgctgggaatctattctgcgactaaatttgcaactcgcggattggttcaagcggcagcaaaagaattggccgtcgacaagattcgcgtcaatgcctataacccaggaattgtcctgacaccaatgtgggatgaaatcgatgcccgttttgccgagcgtaaaaacgttcccgttggatcgacacgccaggcatttatagatggaattctattgggacgtggtgaagaacctgaagatgttgctaaattggtcagcttcttgtccggcgatgaaagtgattatattaccggtcagtcaatcgcggtcgatggtggaattaaattttcttaa

SEQ ID NO: 110 - protein, 257 aa, Oenococcus oeni
MTNKVAIVTGGGQGIGRGIALRLSKDGYSVIINGRTQEKLDKVAEEIKNNNGKVITFVGDVSSKSANEQLVKKAESEFGRLDVFVANAGIDWVDTIEGTPADQVDNVININLKSQIWALQTAPKVMRKSGDGGSIVLASSIAGMEGFEMLGIYSATKFATRGLVQAAAKELAVDKIRVNAYNPGIVLTPMWDEIDARFAERKNVPVGSTRQAFIDGILLGRGEEPEDVAKLVSFLSGDESDYITGQSIAVDGGIKFS

SEQ ID NO: 111 - DNA, 774 bp, Bacillus coagulans
  CDS (1)..(774): Bacillus coagulans 36D1; gene Bcoa_1663 encoding acetoin reductase
atgtctaaagttgcaattgtaacaggatcagctggtgggttaggaaaaggcattgcagaaagattatgctcagatggttttagtgttgttgttcatgatattaacgaacaactattaaatgaaaccgtcaacgaatttaaaaataaaggttatgatgttattggcgtcaaaggtgacgtgtctaaacgaaatgaccaatttaatcttgttaaaaaaggtgttgagaagtttggccatttagatgtatttgtaaataatgctggaattgatgcagtatccccattcttagaaattacagaggaacagctgaataagctctttagtattaatgtaaatggcgttgtttttggaacacaagcagcagccgaacaatttataagccagaaatcaaaagggaaaattatcaacgcatgcagtatagctggacatgaatcctacgaaatgttgggtacatactcagctacgaaacacgcagttaaatcctttactcattccgctgccaaagaattagccaaatatcaaattacagtgaatgcatactgccctggtgtcgctaagacgaaaatgtgggatcgaattgatgaagaaatggtcaaatatagtgatgatttaaaacctggtgaagcatttgaaaagttttcttctgaaatagcattaggaagatatcaaaccccggaagatgtagcaaacttagtttcattcttagcatcagatgacgctgattatataacaggacaagcaattttaacagatggtggacttgtatatagataa

SEQ ID NO: 112 - protein, 257 aa, Bacillus coagulans
MSKVAIVTGSAGGLGKGIAERLCSDGFSVVVHDINEQLLNETVNEFKNKGYDVIGVKGDVSKRNDQFNLVKKGVEKFGHLDVFVNNAGIDAVSPFLEITEEQLNKLFSINVNGVVFGTQAAAEQFISQKSKGKIINACSIAGHESYEMLGTYSATKHAVKSFTHSAAKELAKYQITVNAYCPGVAKTKMWDRIDEEMVKYSDDLKPGEAFEKFSSEIALGRYQTPEDVANLVSFLASDDADYITGQAILTDGGLVYR

SEQ ID NO: 113 - DNA, 981 bp, Lactococcus lactis
  CDS (1)..(981): Lactococcus lactis subsp. cremoris MG1363; gene llmg_1642 encoding 2,3-butanediol dehydrogenase
  misc_feature (1)..(3): Met inserted by tRNA at start codon instead of Val
gtggcttggtgtggaatctgtggtacagatttgcacgaatttttagatggaccaattttttgtccatcagcagaacatccaaatcctattacaggtgaagttccaccagttactctcggacatgaaatgtctggtattgtaaactttgtaggtcaaggggtaagtgggctcaaagtaggtgaccatgtcgttgttgaaccttatatcgttcccgaaggtactgatacaagtgaaactggacattacaatctctcagaaggatcaaactttattggtttgggcggaaatggcggcggtctggctgaaaaaatttcagttgatgaacgttgggtacataaaattcctgacgatttaccattagatgaagcagcactaattgaaccactttctgtgggatatcatgctgttgaacgtgctaatttgagtgaaaagagtacggtactagttgttggagctggtccaatcggacttttgacagctgcagttgccaaagctcaagggcatacagtaattattagtgagcctagtggtttgcgtcgtaaaaaagctcaagaagcagaagttgctgattatttctttaatccaattgaagatgatattcaggcaaaagttcatcaaattaatgaaaaaggagttgatgctgcttttgaatgtacttctgttcaaccaggatttgatgcgtgtttagattctattcgcatgggtggaacagttgttatcgttgcaatttggggtaaaccagctagtgttgacatggcaaaattagtcattaaagaagctaatcttttagggactattgcttataataatactcatcctaaaaccattgatttagttgcaactggtaagattaaattgaatcaatttattacaggtaaaattggcttagatgacctgattgataaaggttttgatactttgattcatcacaatgaaacagcagttaagattttagtttcaccaactggaaaaggtctataa

SEQ ID NO: 114 - protein, 326 aa, Lactococcus lactis
VAWCGICGTDLHEFLDGPIFCPSAEHPNPITGEVPPVTLGHEMSGIVNFVGQGVSGLKVGDHVVVEPYIVPEGTDTSETGHYNLSEGSNFIGLGGNGGGLAEKISVDERWVHKIPDDLPLDEAALIEPLSVGYHAVERANLSEKSTVLVVGAGPIGLLTAAVAKAQGHTVIISEPSGLRRKKAQEAEVADYFFNPIEDDIQAKVHQINEKGVDAAFECTSVQPGFDACLDSIRMGGTVVIVAIWGKPASVDMAKLVIKEANLLGTIAYNNTHPKTIDLVATGKIKLNQFITGKIGLDDLIDKGFDTLIHHNETAVKILVSPTGKGL

SEQ ID NO: 115 - DNA, 1341 bp, Lactococcus lactis
  CDS (1)..(1341): Lactococcus lactis subsp. cremoris MG1363; gene llmg_0408 encoding H2O forming NADH oxidase
atgaaaatcgtagttatcggtacaaaccacgcaggcattgctacagcgaatacattacttgaacaatatcccgggcatgaaattgtcatgattgaccgtaatagcaacatgagttatctaggttgtggcacagcaatttgggttggaagacaaattgaaaaaccagatgaattattttatgccaaagcagaggattttgaggcaaaaggggtaaaaattttgactgaaacagaagtttcagaaattgattttgctaataagaaagtttatgcaaaaactaaatctgatgatgaaataattgaagcttacgacaagcttgttttagcaacaggttcacgtccaattattcctaatctaccaggcaaagaccttaagggaattcattttctgaaactttttcaagaaggtcaagcaattgacgcagaatttgccaaagaaaaagtcaagcgtatcgcagtcattggtgcaggatatatcggtacagagattgcggaagcagctaaacgtcggggtaaagaagttcttctctttgacgctgaaaatacttcacttgcatcatattatgatgaagaatttgccaaaggaatggatgaaaaccttgctcaacatggaattgaacttcattttggagaactggccaaagaatttaaagcgaatgaggaaggttatgtatcacaaatcgtaaccaacaaggcgacttatgatgttgatcttgtcatcaattgtattggttttactgccaacagtgccttggcaagtgataagttagctaccttcaaaaatggcgcaatcaaggtggataagcatcaacaaagtagtgatccagatgtttacgcggtaggtgatgttgcgacaatttattctaatgccttgcaagattttacttatatcgctcttgcctcaaacgctgttcggtcaggaattgtcgcaggacacaatattggtggaaaagaattagaatctgttggtgttcaaggttctaatggtatttcgatttttggttacaatatgacttctacaggactttctgttaaagctgctaaaaaattaggtttagaagtttcatttagtgattttgaagataaacaaaaagcttggtttcttcatgaaaacaacgatagtgtgaaaattcgtatcgtatatgagacaaaaagtcgcagaattattggagcacaacttgctagtaaaagtgagataattgcaggaaatataaatatgttcagtttagcgattcaagagaaaaaaacaattgatgaactagctttgcttgatttattctttctcccccacttcaacagtccatataattatatgacagttgcagctttgaatgccaaataa

SEQ ID NO: 116 - protein, 446 aa, Lactococcus lactis
MKIVVIGTNHAGIATANTLLEQYPGHEIVMIDRNSNMSYLGCGTAIWVGRQIEKPDELFYAKAEDFEAKGVKILTETEVSEIDFANKKVYAKTKSDDEIIEAYDKLVLATGSRPIIPNLPGKDLKGIHFLKLFQEGQAIDAEFAKEKVKRIAVIGAGYIGTEIAEAAKRRGKEVLLFDAENTSLASYYDEEFAKGMDENLAQHGIELHFGELAKEFKANEEGYVSQIVTNKATYDVDLVINCIGFTANSALASDKLATFKNGAIKVDKHQQSSDPDVYAVGDVATIYSNALQDFTYIALASNAVRSGIVAGHNIGGKELESVGVQGSNGISIFGYNMTSTGLSVKAAKKLGLEVSFSDFEDKQKAWFLHENNDSVKIRIVYETKSRRIIGAQLASKSEIIAGNINMFSLAIQEKKTIDELALLDLFFLPHFNSPYNYMTVAALNAK

SEQ ID NO: 117 - DNA, 981 bp, Lactobacillus casei; identical to SEQ ID NO: 13
  CDS (1)..(981): Lactobacillus casei ATCC 334; gene LSEI_2549 encoding H2O-forming NADH oxidase
  misc_feature (1)..(3): Met inserted by tRNA at start codon instead of Val

SEQ ID NO: 118 - protein, 326 aa, Lactobacillus casei; identical to SEQ ID NO: 14

SEQ ID NO: 119 - DNA, 1413 bp, Lactobacillus plantarum
  CDS (1)..(1413): Lactobacillus plantarum WCFS1; gene lp_0760 encoding H2O-forming NADH oxidase
atgaagattgtaattgttggatgtacgcatgcggggaccgctgcggctgcacaaattctgaaggatcatccggaggctacggtcacgatttatgagcgtgatgacaatatttcattcttatcatgtgggatctacctttatctcgggggaaaggtcaatcacttggaagatatgttctattcgtcaccagaaacgttagccaagttgggggcaatggtcagaaccaaacataacgtgttaaaaattgacgcccagtcgaagaccttacaagtggttgacatgactactggaaaagtgtttggcgatacttatgataaattgattatgacgactggttcaaatgttgcggtcccgccgatttttggaatcgatgagtctaaggtcctattatgcaagacctacagccaagcacaggaaatttaccaaacagcccaagacaatcagcggatcgcaatcattggggcgggttatattggaaccgaattatctgaaagttatgcaaatacacatcatgaagtaacgttattccaatcgcatgatcaaattttgaataattacattagtaaagaaatttcagaccaagcagttcagctattaaaagatcatggcgtgaacgtgctattgaatcaccaagtaactgcctttactggtaatgatgatggtgaacttgtcattgaaaccaatcaaggcgattttaatgctgatctagcaattgtcggaactgggtttgttcccaatacagaactgttacgcggtcaagttgagatggataagcacggtgccattatcatcaatgattacgttcagacctctgacccagatatttacgctgctggtgattcttgtgtcgttaacttcaacccaactgggcgttcggcttatacgccattagcaaccaatgcggttcggcagggtgcgttagcgggggccaatgtttttggtaaccagcaacgatatatggggactcaagcgacatcggccatgcaactcttcgatcacacgctggcaaccacggggttaacactggcaatggcgaaattgaatcatattccagctgaacgggtgacttatgagggcaactggcgaccagcttacatgccaagtacggcgaaactgacgattgaattaatttataatccggaaaatcgtaaaattctcggtgctcagttcttaagtgcgcatgaagtggcacagtctgctaatgcgttatcaatcgcgattcaaaatggaaacaccatcgatgatctagcatttgtggatatgttattctcacctaattttgatgaaccattcaattatctgaacctcgtcgcccaacaagcgattgaacaagaacgccaggcaggccgcaatcacccacgaattacggcctatggcgattgggccaagcaaaatgacaaggatttacaataa

SEQ ID NO: 120 - protein, 470 aa, Lactobacillus plantarum
MKIVIVGCTHAGTAAAAQILKDHPEATVTIYERDDNISFLSCGIYLYLGGKVNHLEDMFYSSPETLAKLGAMVRTKHNVLKIDAQSKTLQVVDMTTGKVFGDTYDKLIMTTGSNVAVPPIFGIDESKVLLCKTYSQAQEIYQTAQDNQRIAIIGAGYIGTELSESYANTHHEVTLFQSHDQILNNYISKEISDQAVQLLKDHGVNVLLNHQVTAFTGNDDGELVIETNQGDFNADLAIVGTGFVPNTELLRGQVEMDKHGAIIINDYVQTSDPDIYAAGDSCVVNFNPTGRSAYTPLATNAVRQGALAGANVFGNQQRYMGTQATSAMQLFDHTLATTGLTLAMAKLNHIPAERVTYEGNWRPAYMPSTAKLTIELIYNPENRKILGAQFLSAHEVAQSANALSIAIQNGNTIDDLAFVDMLFSPNFDEPFNYLNLVAQQAIEQERQAGRNHPRITAYGDWAKQNDKDLQ

SEQ ID NO: 121 - DNA, 1359 bp, Lactobacillus plantarum
  CDS (1)..(1359): Lactobacillus plantarum WCFS1; gene lp_0766 encoding H2O-forming NADH oxidase
atgaaagttgccattattggctgtacacatgcggggattgccgccatgaaacaaatcttgaaatattatccgggcactgaaattaccgtctatgaacggcacgcggatatttcatatatgtcttgtgggacttatctacacttagggggtaccatccataatttggatcaagcgttgtacgctaatcctagtgaatttagtgaacaaggtgtgcagatgcggatgcagtatgatgtgatcaatgtgaatgctgataagcatacaattttggctcaaaatttacagacaaaagaattacaaacggatcactatgataagttagtcatggcgacgggttcaatcactgcaatcccggctattccgggcgtagagaatcctaaggtcatgctttgcaaaacatgtgaacaggcccagcaactctacgaagcagctaaacatgcacaccatattgcaatcgttggtggtggctattcgggggtggaacttgctgaggggtacgtgaagtctggacacactgtgacgttgtttcaacggggcccccacttaattaatgagtatcttgatccacaaatttctgagaagatcgaagacttgttaacgacgaaaggcatccaagttagaaccaatgcacaagtgacggcttttagtgatacggctgataatcgactacgagttgcaaccgctgatagtgaagaaatatttgatatggctgttatttgtccgggggtgattccacaatcagagttattggcgggacaggtcaaccgaacgaagcagggggccattgtaacggaccgttatatgggaacctccaacccggatatatttgcggctggcgatgtgacggaagttaactttaatcctacgaaggaacacgcctatatgccattagtctcacatgcaattcggcaaggtgcactggcaggaattaatatctttgataaacgcttaggtgcaattggtacgcaagcgacgactgggatgttgatttttgatcagaccgtggcttgtgcaggtctgaccttaacggcggccaaagcagctaacttcgatgcccaagcagctttttatgaaggcaattatcggccggactttatgcctaccacggcgaaagtcatgattgagttggtttatgatcaacaaacgcggaaggttttgggtggtcaactaatgagtgctcatgaagtttcacaatcagcaaatacgttgtccgtagtgattcataatggtaatacgattgatgaattagccttcatggatatgctattctcacccaactttgatgaaccgtttaattacttgaatttagtggcgcaggctgcagtagatcaggaacatggctatcgtcggaataattaa

SEQ ID NO: 122 - protein, 452 aa, Lactobacillus plantarum
MKVAIIGCTHAGIAAMKQILKYYPGTEITVYERHADISYMSCGTYLHLGGTIHNLDQALYANPSEFSEQGVQMRMQYDVINVNADKHTILAQNLQTKELQTDHYDKLVMATGSITAIPAIPGVENPKVMLCKTCEQAQQLYEAAKHAHHIAIVGGGYSGVELAEGYVKSGHTVTLFQRGPHLINEYLDPQISEKIEDLLTTKGIQVRTNAQVTAFSDTADNRLRVATADSEEIFDMAVICPGVIPQSELLAGQVNRTKQGAIVTDRYMGTSNPDIFAAGDVTEVNFNPTKEHAYMPLVSHAIRQGALAGINIFDKRLGAIGTQATTGMLIFDQTVACAGLTLTAAKAANFDAQAAFYEGNYRPDFMPTTAKVMIELVYDQQTRKVLGGQLMSAHEVSQSANTLSVVIHNGNTIDELAFMDMLFSPNFDEPFNYLNLVAQAAVDQEHGYRRNN

SEQ ID NO: 123 - DNA, 1692 bp, Lactobacillus plantarum
  CDS (1)..(1692): Lactobacillus plantarum WCFS1; gene lp_1925 encoding H2O-forming NADH oxidase
atggaagtgaaaaaagtggtcattgttggtggcgttggtggtggtgcttcggcggcggcccgcgtgcgtcgattggacgagttcgcccagattacaatttttgaaaaggggccggatgtctcattttccaattgtgccttaccgtacacattcagtgatgtgattgaccagcccgatgacgtgattttaaagacaccgatgcaattcgagcaacagtacaatattgacgttcaagtgaatacaacggttgtcgccattgatgcgcaggctaagacagtgatgatcaaacggcaaggacaggtagcaacgacgatcgtcccatatgatacactgattctttcacctggtgctcgaccaatactacccgcagtgattgcgggaatcgaccggcccaatgttaaaacggtccgcaatgttcaagatgtccgaacgattcaagcgtatctgactgaacaacacgttcatgatgtgacgattgttggcggtggctttatcggactagagatggctgaaaatttacaacaggctggctatcagatcacaatcattgaggctgccgagcacgtcttgggcactttggatgacgagtttgctcagctagtacacaaggaactatacgatcacggtgtgcaggtgatactgcaagaacaagtgacggccattggtgcaacacaagtgcagctcgcctcgggacgcgccgtgaccagccagttagtgattgtggcaattggggttacaccagtaactgaattagcggttcaagcgggttgtgcgttaggcgtgaccggtggtatcaaggttgatcatcgttaccagacgtccgtggccgacatttatgcggtgggtgatgccattgaagtgactaatcggcttacacgtcaatctacgcggctagcattggcatttcccgcacaaatgcaggcccgacacatggtggatcatttatacgggcggacgccacagtatcagggtgtgatcggatcgcaggttcttcacgtctttacgttaaacgtggcgtcaacgggcctgaacgctactgagtgtgagcaccagcaacttgattatcggttcgcaacggtggcaccacagaatcgggtcagcgtgatgccagggacaacagccgtctttcttaagttgatattcagttatccgaccggtgagattttgggcgcgcaggccattggtcaatcggacgttgacaaaccgattgatattatcgctagtctaatcacgatgcacggtcgagtcagtgacctgacagatgttgaattatgttattcgccatgggtcagtaccgccaaaaatgtcgtcaacatggttggcttggtggcggaaaacgtcctgaatgatgaatttaagcaggttgcggtgacacaggttcgacagctggtcttggcgggggcgtttatcatcgatgcccgtgaaccacaagagtacgctgatgggcacatcaagggcgcgcataatattccactgagtcagtttcgacagcgcttagtggaaattccaaccaatcagccagtttatattcattgtcagaccggacagcgaagttacaatatggtccgcgcgttacttcagcgcggctatacgaatgtggtcaacattgctgggtcgtatgccgaactagttcagtatgaatattttaatgatcagacaacagggcgaacctcaattctgacacgaacatga

SEQ ID NO: 124 - protein, 563 aa, Lactobacillus plantarum
MEVKKVVIVGGVGGGASAAARVRRLDEFAQITIFEKGPDVSFSNCALPYTFSDVIDQPDDVILKTPMQFEQQYNIDVQVNTTVVAIDAQAKTVMIKRQGQVATTIVPYDTLILSPGARPILPAVIAGIDRPNVKTVRNVQDVRTIQAYLTEQHVHDVTIVGGGFIGLEMAENLQQAGYQITIIEAAEHVLGTLDDEFAQLVHKELYDHGVQVILQEQVTAIGATQVQLASGRAVTSQLVIVAIGVTPVTELAVQAGCALGVTGGIKVDHRYQTSVADIYAVGDAIEVTNRLTRQSTRLALAFPAQMQARHMVDHLYGRTPQYQGVIGSQVLHVFTLNVASTGLNATECEHQQLDYRFATVAPQNRVSVMPGTTAVFLKLIFSYPTGEILGAQAIGQSDVDKPIDIIASLITMHGRVSDLTDVELCYSPWVSTAKNVVNMVGLVAENVLNDEFKQVAVTQVRQLVLAGAFIIDAREPQEYADGHIKGAHNIPLSQFRQRLVEIPTNQPVYIHCQTGQRSYNMVRALLQRGYTNVVNIAGSYAELVQYEYFNDQTTGRTSILTRT

SEQ ID NO: 125 - DNA, 1407 bp, Lactobacillus plantarum
  CDS (1)..(1407): Lactobacillus plantarum WCFS1; gene lp_1941 encoding H2O-forming NADH oxidase
atgaaagtaatgatcatcggtagtacccacgctggtacggcagcggcacgcgaaattttaacacgtcatccggagacggcggtgacgatttacgagcggaatgataacgtttcgtttgtttcgagtgggatttatttgtacttaacgggtgtcatccaacacctggaagacatgttttacacctcgccgtctgacttgaagcagttaggcgctcaagttaagacccgccataatgttttacgaattgatacgggccataaaacggtgcaggtcgccaatatgcagactggcgaagtctttgatgacacttatgataagctgattatggcaactggttcatcagttattgtgccaccaattatgggtatcgatcatgagaaagtattactgtgcaaaaactacgagcaggcggaacaactttatcaatctctacaggccaaccaacgcgttgcaattgttggggccggatatatggggaccgagttagcggaaagctatgctagtatggaccaacaagtcatgttatttcattcgcattcacatattttgaataattatcttggcccccaaatggcggatgctgcaactaaactcttacaacatcaccaggtcgatatccacctcaatgaacgggtgactggattcgcaagcggttcgaatgatcagttgatcgttgaaaccgcgcagggtgattatgaggttgatctggccgtcgtttgcgcgggctttatgccgaatacggaattgttacgcgggcaggtcgctatggaccgccatggtgctatcttgatcaatgattatgttcaaacctctgacccggatatttatgcggctggggatgcttgcgtggtcaattataatcccacgggacagccggcgtatacaccattggcaactaacgcactgcgccaaggtgcgttggcggggatcaatgttttcggagatttacagccgtacatgggaacgcaagccacctcagccatgcaattatttgatcacacgatggccacaactgggttgacctatctagccgcgcaaagacgagaactaccagtacgacacgccgtctatcaaggcaattggcggccagcttatatgccgacgacggccaaagtcacgattgaactagtttataattatcagaatcgtcagcttctcggcgcgcaattctggagtcgtcacgacattgcccaagctgcaaacacgatctcagtaatgattcaaaatcagaatacgattgatgatttggcttacgtggatatgttctttcagccgaattttaatcaaccgttcaactatttaaatttggtggggcaactagccgtcaaacaagaatatcagcgaggcaatcaaacaccacgaattacagctcgtggtaactggtcgactagtagtgataagcattga

SEQ ID NO: 126 - protein, 468 aa, Lactobacillus plantarum
MKVMIIGSTHAGTAAAREILTRHPETAVTIYERNDNVSFVSSGIYLYLTGVIQHLEDMFYTSPSDLKQLGAQVKTRHNVLRIDTGHKTVQVANMQTGEVFDDTYDKLIMATGSSVIVPPIMGIDHEKVLLCKNYEQAEQLYQSLQANQRVAIVGAGYMGTELAESYASMDQQVMLFHSHSHILNNYLGPQMADAATKLLQHHQVDIHLNERVTGFASGSNDQLIVETAQGDYEVDLAVVCAGFMPNTELLRGQVAMDRHGAILINDYVQTSDPDIYAAGDACVVNYNPTGQPAYTPLATNALRQGALAGINVFGDLQPYMGTQATSAMQLFDHTMATTGLTYLAAQRRELPVRHAVYQGNWRPAYMPTTAKVTIELVYNYQNRQLLGAQFWSRHDIAQAANTISVMIQNQNTIDDLAYVDMFFQPNFNQPFNYLNLVGQLAVKQEYQRGNQTPRITARGNWSTSSDKH

SEQ ID NO: 127 - DNA, 1353 bp, Lactobacillus plantarum
  CDS (1)..(1353): Lactobacillus plantarum WCFS1; gene lp_3449 encoding H2O-forming NADH oxidase
atgaaagttattgtaattggttgtacccatgccggcactgctgccgttaatcagattttagcatcaaatccagatactgaagtgacgatttatgaaagaaatgacaatgtctcgttcctatcctgtgggatcgcactttaccttggcggccaagttgctgatcctcaaggcctattttattccagtcctgaacagttagctaagttaggcgcaactgttcatatgcaacatgatgtgacggatgtgaatactgacaaacatgaaattacggttactgatttaaagactggtgaatctaagactgatcactatgacaagttagttgtcactactggttcatggcctgttattccaccaattgacggcatcgatagtcccaatgtctacttatgcaagaactggacgcacgctcagaatttatgggaagcagccaaaccagctaagcgggtcattgtgatcggtggcggttatatcggtactgaattagttgaagcttaccagaagcaaggtaaggaagtcacactaattgatggtttaccacggattttaaataaatacttagacaaagaattcactgaccgggttgaacaagactttgttgatcacggtatcaagatggctttgaatcaaatggtgcaaggcttcagtgatgatggtaaagaagttacggtcaagactgacaagggcagctacacagccgacatggcgattctttgtgttggcttccggccaaataccggcttactcaagggcaaggtcgatatgaacgctaatggctcgatcaagaccaatgactacatgcaaacttctgatccagacatttacggggctggtgactcggttgctgttcactataacccaactaagaaagatgcttatatcccattagcaacgaatgcggttcgccaaggaaccttagttggtttgaacatcttcaagccaacgcggaagtacatggggacacaatcaacttctgggttaatgttgttcggccaaaccatcgtttcatctgggatgaccctagaacatgcacaggccgaaaatgttccggcagccgctgtcacttttgaagacaactaccggccagaatttatgccaaccactaagcctgttttaatgcaattggtttacaatcctgaaactcgcgaaatcctaggtgcacaattcatgagtgaacatgatgtttcgcaatcagccaatgtgatttcagtgatgattcaaaatcacaataccattgacgacttagggttcgtagatatgttcttccaaccaatttacgaccggccatttaactatttgaacttacttggtcaagcagcgattgcccatgcggccgaagctgtcactgaataa

SEQ ID NO: 128 - protein, 450 aa, Lactobacillus plantarum
MKVIVIGCTHAGTAAVNQILASNPDTEVTIYERNDNVSFLSCGIALYLGGQVADPQGLFYSSPEQLAKLGATVHMQHDVTDVNTDKHEITVTDLKTGESKTDHYDKLVVTTGSWPVIPPIDGIDSPNVYLCKNWTHAQNLWEAAKPAKRVIVIGGGYIGTELVEAYQKQGKEVTLIDGLPRILNKYLDKEFTDRVEQDFVDHGIKMALNQMVQGFSDDGKEVTVKTDKGSYTADMAILCVGFRPNTGLLKGKVDMNANGSIKTNDYMQTSDPDIYGAGDSVAVHYNPTKKDAYIPLATNAVRQGTLVGLNIFKPTRKYMGTQSTSGLMLFGQTIVSSGMTLEHAQAENVPAAAVTFEDNYRPEFMPTTKPVLMQLVYNPETREILGAQFMSEHDVSQSANVISVMIQNHNTIDDLGFVDMFFQPIYDRPFNYLNLLGQAAIAHAAEAVTE

SEQ ID NO: 129 - DNA, 1386 bp, Streptococcus thermophilus
  CDS (1)..(1386): Streptococcus thermophilus CNRZ1066; gene str1281 encoding H20-forming NADH oxidase
  misc_feature (1)..(3): Met inserted by tRNA at start codon (TTG) instead of Leu
ttggataaatttatgtcaaaaatcgtagttgtcggtgctaaccatgctggtacttatagtattaatactattcttgataattacggagaccaaaatgaagtagttgttttcgatcaaaactctaacatttcattcttgggttgtggtatggctctttggattggtaatcaaatctcaggtcctgatggccttttctatgccaacaaagaaggccttgaaagcaagggtgcaaaagtttatataaactcaccagttgagtctattgactttgacggtaaaactgttacagctcttgttgatggtaaagaacatgttgaatcatatgacaaattgattttagctactggttcacaaccaatcttacctccaatcgatggtgctgagattaaagaaggtagccgtactttcgaagcgactcttgaaaaccttcaattcgttaaacttttccaaaacgctcaagaagttattgataagttgaacgataaatcacaagacatcaaacgtgtagcagtcgttggtgcaggttacattggtgttgaattggctgaagccttccaacgtcatggtaaagaagttatccttattgatgttgttgacacatgtttggcaggatactatgaccgcgattttacagaccgtatggctaaaaatttggaagaccacggtatccaattggcctttggcgaaactgttaaagcagtagaaggtgaaactaaggtagaacgcatcgtaacagataaaaatgcgtacgatgtagatatggttgttcttgctgttggtttccgtcctaatacagcccttggagctggtaaattggaaacattccgaaatggtgcttaccttgttaataagaaacaagaaacatcagttaaggatgtttacgctgttggtgattgtgctacggtttatgacaatgctcttgacgatgtcaactacattgccttagcttcaaatgctattcgttcaggtattgtcgctggacacaatgccggtggtggtgatgttgaatcaaacggtgttcaaggatcaaatggtatctctatctatggtttgaacatggtttctactggtttgactgaagagaaggcaaaacgctttggtttcaatccagcagtagtagaatcaacggatcttcaaaaacctcccttcatgaaggatgaaaatgaagatgtaactatcaagattgtttatgataaagatactcgtaaagttttgggtgctcaaatggtttcactcatggatatctcaatgggaatccacatgttctcattggcaattcaagaaggagtaacaattgaccgtctacaattgcttgatttgttcttcttgccacactttaaccaaccacttagctatattgctaaagcagctatctccgctgaataa

SEQ ID NO: 130 - protein, 461 aa, Streptococcus thermophilus
LDKFMSKIVVVGANHAGTYSINTILDNYGDQNEVVVFDQNSNISFLGCGMALWIGNQISGPDGLFYANKEGLESKGAKVYINSPVESIDFDGKTVTALVDGKEHVESYDKLILATGSQPILPPIDGAEIKEGSRTFEATLENLQFVKLFQNAQEVIDKLNDKSQDIKRVAVVGAGYIGVELAEAFQRHGKEVILIDVVDTCLAGYYDRDFTDRMAKNLEDHGIQLAFGETVKAVEGETKVERIVTDKNAYDVDMVVLAVGFRPNTALGAGKLETFRNGAYLVNKKQETSVKDVYAVGDCATVYDNALDDVNYIALASNAIRSGIVAGHNAGGGDVESNGVQGSNGISIYGLNMVSTGLTEEKAKRFGFNPAVVESTDLQKPPFMKDENEDVTIKIVYDKDTRKVLGAQMVSLMDISMGIHMFSLAIQEGVTIDRLQLLDLFFLPHFNQPLSYIAKAAISAE

SEQ ID NO: 131 - DNA, 1992 bp, Bacillus coagulans
  CDS (1)..(1992): Bacillus coagulans 36D1; gene Bcoa_0725 encoding H2O-forming NADH oxidase
atgaaatacaaaaagctatttgaaactgtgaaaataaggaatgtggaactcaaaaatcgttatgcaatggcaccaatgggtccgctgggtcttgccgatgcagaaggcggtttcaaccagcgcgggattgagtattatacagcccgtgcgcgcgggggaaccgctctgattattaccggcgtcactttcgttgataatgaagtggaagagcacggaatgccaaacgtaccttgcccgacccataaccctgtccattttgtccggacttccaaagaaatgacagagcgcatccatgcatatgattcgaaaatttttctgcaaatgagcgccggttttggccgggtgacgatcccgacaaaccttggcgagtacccgccggttgcaccgtcgccaatcccgcatcgctggctggataaaacatgtcgcgaactgacagttgaagaaattcattccattgtccgcaaattcggggatggggcgttcaatgcgaagcgcgccggatttgacggggtgcaaatccatgctgtgcacgaaggctatttgctcgaccagtttgcgattgcgtttttcaacaaacgtaccgatgcatacggtggcccgcttgaaaatcgccttcgttttgcccgggaaattgtcgaggaaattaaacagcgctgtggcgaagattttcctgtgacgctccgcttcagcccgaaaagttttatcaaggattggcgggaaggggcactgcctggcgaggagtttgaagaaaaaggccgcgatttggatgaaggcatcgaggcagcaaagctgctcgtttcctacggctatgatgctctggacgtcgatgttggttcttatgattcatggtggtggagccatcctccgatgtaccagaagaaggggctttacattccgtatgccaggctggtgaaggaagctgtcgatgtgcctgtcctttgcgcgggccgcatggacaatccggatcttgcacttgccgcactggaagacggagcatgtgatattatcagcttgggccgcccgttattggctgacccggattacgtcaataagctccgaatcgggcaggttgccgatatccgcccgtgtctgtcatgccatgaaggctgcatgggtcggatccaggagtattcttccttaggctgcgcagtgaatccggctgcctgtcgagaaaaagaagcagcattgacacctgctttaaaaaagaaacgcgtactgattgcaggcggcggcgtggccggatgcgaagctgcccgtgtgcttgcattgcgcggccatgaaccggtcatttttgaaaaatcgaaccgtttaggcggcaacttgatccctggcggcgcacctgattttaaagaagatgacctggcgcttgttgcctggtatgagcatacgttggaacgccttggcgtagaaattcatttgaatactgcattgacaaaagaagaaattttggctgcaaacgtggatgccgtgctgattgcaacgggttcgaatccgaaaattttgccgctcgacggaaaaaacaaagtatttacagcagaagatgttttgctcgataaagtggatgccgggcaacatgttgtcattgtcggcggcggtcttgtcggctgcgaactggctttgaaccttgcagaaaaaggaaaagatgtctcgcttgtggaaatgcaggacaaactgctggcagttaatggtccgctttgccacgctaactcggacatgctggaaagactcgtaccgtttaaaggtgttcaagtctacacttcttcaaaaatagtagatacgacagaaaagacagccgttgtggatgttgacggcgaattgcgtgaaattgaagcagacagcattgtgctcgcagtcggctactcggctgaaaaatcactctatgaagatttaaagtttgaggttgccgatcttcatgtggttggcgatgcccgcaaggtcgcaaacatcatgtatgccatctgggatgcttacgaagtcgcggcaaatctgtaa

SEQ ID NO: 132 - protein, 663 aa, Bacillus coagulans
MKYKKLFETVKIRNVELKNRYAMAPMGPLGLADAEGGFNQRGIEYYTARARGGTALIITGVTFVDNEVEEHGMPNVPCPTHNPVHFVRTSKEMTERIHAYDSKIFLQMSAGFGRVTIPTNLGEYPPVAPSPIPHRWLDKTCRELTVEEIHSIVRKFGDGAFNAKRAGFDGVQIHAVHEGYLLDQFAIAFFNKRTDAYGGPLENRLRFAREIVEEIKQRCGEDFPVTLRFSPKSFIKDWREGALPGEEFEEKGRDLDEGIEAAKLLVSYGYDALDVDVGSYDSWWWSHPPMYQKKGLYIPYARLVKEAVDVPVLCAGRMDNPDLALAALEDGACDIISLGRPLLADPDYVNKLRIGQVADIRPCLSCHEGCMGRIQEYSSLGCAVNPAACREKEAALTPALKKKRVLIAGGGVAGCEAARVLALRGHEPVIFEKSNRLGGNLIPGGAPDFKEDDLALVAWYEHTLERLGVEIHLNTALTKEEILAANVDAVLIATGSNPKILPLDGKNKVFTAEDVLLDKVDAGQHVVIVGGGLVGCELALNLAEKGKDVSLVEMQDKLLAVNGPLCHANSDMLERLVPFKGVQVYTSSKIVDTTEKTAVVDVDGELREIEADSIVLAVGYSAEKSLYEDLKFEVADLHVVGDARKVANIMYAIWDAYEVAANL

SEQ ID NO: 133 - DNA, 1119 bp, Bacillus coagulans
  CDS (1)..(1119): Bacillus coagulans 36D1; gene Bcoa_0915 encoding H2O-forming NADH oxidase
atgagcaaatacgataaactgtttgaaccaattacgtttaaaagcggcgtcagggcggaaaaccgcatcgtgatggcgccgatgacccattattcctcgaatgatgacggcacgatttccgctgccgagctgcgttattatgcagaacgtgccaaagggccggggatggtcgtgacggcatgtgccaatgttacggaaaacggcaaagcatttaccgggcaacctggcgcgcatacagatgaaatggttgagagcatgaaaaaactagcacaaacgattcagcaaaacggtgcaaaagcggttgtgcaaatccaccatggtggccgcgaatgcccggctgaactcgtgccgggcggggatgttgtgagcgcaagtgaaacagattcgtcagacggcagcgtccatgcacgcgcgttgacgggagaagaaaccgctgaaattgtgaaagcattcggcgaagcaacacgccgcgtgatcgaagctggttttgatggcgttgaaattcacggcgcaaacggctatctgattcaacaatttttctccccgtatacgaaccggcgtgaagacgagtggggcggcagtctggaaaaacggcttgcattcccgcttgctgtcgtcgatgctgtgaaaaaaacggtggcggaatatgcggaccggccgtttttagtcggataccgcttatccccggaagaaccgtacgaaccggggattacgatggatgacacgttcgcgcttttggatgcgctgatgaaaaaagagctcgactatgtgcatatttccctgcagcacttctggtctaaagcccgccgcggcggtgaacccggccgtccgcgcatggaacagatcgtggaacatgtcgcaggccgcgtgcctttgatcggcgtcggctccctgcacacaggagacgaggttttgaaggcaatggaaaccgatgtaccgcttattgccctcggccgtgagcttgtcatggagccgcattgggtggaaaaaattaaagccggccaggaggatgcaattcaaaccgcgttaagaaaagacgaccgcgaacggctcgttattccggaaccgctgtggaagatgatcatctcaacgccgggctggttcccgtttgcagaatga

SEQ ID NO: 134 - protein, 372 aa, Bacillus coagulans
MSKYDKLFEPITFKSGVRAENRIVMAPMTHYSSNDDGTISAAELRYYAERAKGPGMVVTACANVTENGKAFTGQPGAHTDEMVESMKKLAQTIQQNGAKAVVQIHHGGRECPAELVPGGDVVSASETDSSDGSVHARALTGEETAEIVKAFGEATRRVIEAGFDGVEIHGANGYLIQQFFSPYTNRREDEWGGSLEKRLAFPLAVVDAVKKTVAEYADRPFLVGYRLSPEEPYEPGITMDDTFALLDALMKKELDYVHISLQHFWSKARRGGEPGRPRMEQIVEHVAGRVPLIGVGSLHTGDEVLKAMETDVPLIALGRELVMEPHWVEKIKAGQEDAIQTALRKDDRERLVIPEPLWKMIISTPGWFPFAE

SEQ ID NO: 135 - DNA, 1032 bp, Bacillus coagulans
  CDS (1)..(1032): Bacillus coagulans 36D1; gene Bcoa_2324 encoding H2O-forming NADH oxidase
atgaatgatttatttaccccgtacaagctgaaatcgcttgaagtgaaaaaccgtattgtcatgcctcccatgtgccaatattccgttgagaaaaaagacggcgttgccactgactggcattatgtccattacgtcagccgtgccatcgggggcaccggcctgatcattatggagatgaccgatgtggagccggacggcagaattaccgacaacgatctcggcttatggtctgatgagcagatcgcgccgcttgccaaaattgtggaagcgtgccaccagtacggcgccaaagtcgggattcaaatcggacatgccggcagaaaagcacaggatgcaaaacaaccagttgccccttcccccatcccttttgatgaccatgcaaaaacaccgagggcattaacgaaggaagaaatcaaagaaatcgtccgcaaatttggcgaatctgtccgccgcgctgtccaggccggttttgacacgatcgaactgcacggcgcacacggttatctgatccatgaattccagtcgcgctatacaaacaaacggtcagatgaatacggacaggatttggcattatttggaaaagaagtcattgccgctgccaaaagcgaaatgcctgccgacatgccacttattatgcgcatttcagcccgtgaatatgtcgatggcgggtatggcattgaagaaagtattgcgctttcgaaggcgtataaagaagccggtgttgacctgtttcatattagttccggaggcgagggccatatcggtgcggccggccgcccggggacgcacgccgcttatcaggtgccgcttgcacgccagatcaaagaggctttaaacgttccggtcattgcagtcggccggctggaagacccggttcttgccaatgcggtaatcggaaacgaagaagcagatcttgttgcggtcggcagaggcatgctccgcaacccttattgggcgctcaatgcagggatcgcgctcggcaaagacgcaggtgtgccgatccaatatacaagggggtttccaaaaaggtaa

SEQ ID NO: 136 - protein, 343 aa, Bacillus coagulans
MNDLFTPYKLKSLEVKNRIVMPPMCQYSVEKKDGVATDWHYVHYVSRAIGGTGLIIMEMTDVEPDGRITDNDLGLWSDEQIAPLAKIVEACHQYGAKVGIQIGHAGRKAQDAKQPVAPSPIPFDDHAKTPRALTKEEIKEIVRKFGESVRRAVQAGFDTIELHGAHGYLIHEFQSRYTNKRSDEYGQDLALFGKEVIAAAKSEMPADMPLIMRISAREYVDGGYGIEESIALSKAYKEAGVDLFHISSGGEGHIGAAGRPGTHAAYQVPLARQIKEALNVPVIAVGRLEDPVLANAVIGNEEADLVAVGRGMLRNPYWALNAGIALGKDAGVPIQYTRGFPKR

SEQ ID NO: 137 - DNA, 20 bp, Lactococcus lactis
  primer_bind (1)..(20): 43 (T3) primer
aattaaccctcactaaaggg

SEQ ID NO: 138 - DNA, 22 bp, Lactococcus lactis
  primer_bind (1)..(22): Primer 603
atcaacctttgatacaaggttg

SEQ ID NO: 139 - DNA, 108 bp, Lactococcus lactis
  primer_bind (1)..(108): Primer 710
  misc_feature (11)..(15): n is a, c, g, or t
  misc_feature (31)..(44): n is a, c, g, or t
  misc_feature (54)..(57): n is a, c, g, or t
ctagtctagannnnnagtttattcttgacannnnnnnnnnnnnntgrtataatnnnnaagtaataaaatattcggaggaattttgaaatggctgataaacaacgtaag

SEQ ID NO: 140 - DNA, 37 bp, Lactococcus lactis
  primer_bind (1)..(37): Primer 768
aattcctgcagcatattaaataatgaacaagtcattc

SEQ ID NO: 141 - DNA, 32 bp, Lactococcus lactis
  primer_bind (1)..(32): Primer 769
tagtggatcctggtaaatccaaacacaacaac

SEQ ID NO: 142 - DNA, 34 bp, Lactococcus lactis
  primer_bind (1)..(34): Primer 770
aattcctgcagtaatttccagctcttacaataac

SEQ ID NO: 143 - DNA, 31 bp, Lactococcus lactis
  primer_bind (1)..(31): Primer 771
gacctcgagtcagaaactttctttaccagag

SEQ ID NO: 144 - DNA, 21 bp, Lactococcus lactis
  primer_bind (1)..(21): Primer 772
gcggggatccactagttctag

SEQ ID NO: 145 - DNA, 17 bp, Lactococcus lactis
  primer_bind (1)..(17): Primer 773
ataccgtcgacctcgag

SEQ ID NO: 146 - DNA, 30 bp, Lactococcus lactis
  primer_bind (1)..(30): Primer 774
tagtggatccctgtttcaggtcttggatag

SEQ ID NO: 147 - DNA, 33 bp, Lactococcus lactis
  primer_bind (1)..(33): Primer 775
ccgatgaattctcattagcacgtttaacaagag

SEQ ID NO: 148 - DNA, 29 bp, Lactococcus lactis
  primer_bind (1)..(29): Primer 776
ccgatgaattcatcagcgtagtctgctgc

SEQ ID NO: 149 - DNA, 33 bp, Lactococcus lactis
  primer_bind (1)..(33): Primer 777
cggggtaccatttaatcctaaagtcgttattac

SEQ ID NO: 150 - DNA, 32 bp, Lactococcus lactis
  primer_bind (1)..(32): Primer 785
ccgatgaattcttaagtcaagacaacgaggtc

SEQ ID NO: 151 - DNA, 33 bp, Lactococcus lactis
  primer_bind (1)..(33): Primer 786
ccgatgaattcgaccttgttgaaaaaaatcttc

SEQ ID NO: 152 - DNA, 30 bp, Lactococcus lactis
  primer_bind (1)..(30): Primer 787
tagtggatccgtacaatggctactgttaac

SEQ ID NO: 153 - DNA, 33 bp, Lactococcus lactis
  primer_bind (1)..(33): Primer 788
gacctcgaggatgaacagacttttttattatag

SEQ ID NO: 154 - DNA, 20 bp, Lactococcus lactis
  primer_bind (1)..(20): Primer 789
aaaaccaggtgaaactcgtc

SEQ ID NO: 155 - DNA, 38 bp, Lactococcus lactis
  primer_bind (1)..(38): Primer 791
tcggactgcagttaaaatgctgataaaaacaattcttc

SEQ ID NO: 156 - DNA, 17 bp, Lactococcus lactis
  primer_bind (1)..(17): Primer 827
ataccgtcgacctcgag

SEQ ID NO: 157 - DNA, 22 bp, Lactococcus lactis
  primer_bind (1)..(22): Primer 828
cgataagcttgatatcgaattc

SEQ ID NO: 158 - DNA, 52 bp, Lactococcus lactis
  primer_bind (1)..(52): Primer 830
ccgatgaattctataaggagaattagaatggcaagtagtacattttatattc

SEQ ID NO: 159 - DNA, 21 bp, Lactococcus lactis
  primer_bind (1)..(21): Primer 878
atccctcggttacaagtttcu

SEQ ID NO: 160 - DNA, 45 bp, Lactococcus lactis
  primer_bind (1)..(45): Primer 879
agaaacttgtaaccgagggauaataatagattgaaattctgtcag

SEQ ID NO: 161 - DNA, 46 bp, Lactococcus lactis
  primer_bind (1)..(46): Primer 880
attcgatatcaagcttatcgaucaaaaattgtggtagaatatatag

SEQ ID NO: 162 - DNA, 40 bp, Lactococcus lactis
  primer_bind (1)..(40): Primer 881
aggtcgacggtatcgataaucctagttcaattgatgtgac

SEQ ID NO: 163 - DNA, 22 bp, Lactococcus lactis
  primer_bind (1)..(22): Primer 882
atcgataagcttgatatcgaau

SEQ ID NO: 164 - DNA, 20 bp, Lactococcus lactis
  primer_bind (1)..(20): Primer 883
attatcgataccgtcgaccu

SEQ ID NO: 165 - DNA, 48 bp, Lactococcus lactis
  primer_bind (1)..(48): Primer 887
attcgatatcaagcttatcgauatttaaaaatgattgcaacatataac

SEQ ID NO: 166 - DNA, 24 bp, Lactococcus lactis
  primer_bind (1)..(24): Primer 888
ataggtctcctttaaatgtaaaau

SEQ ID NO: 167 - DNA, 46 bp, Lactococcus lactis
  primer_bind (1)..(46): Primer 889
attttacatttaaaggagacctautagaaatctatctgcttgatag

SEQ ID NO: 168 - DNA, 41 bp, Lactococcus lactis
  primer_bind (1)..(41): Primer 890
aggtcgacggtatcgataacgucttcaccgtccattttgac

SEQ ID NO: 169 - DNA, 23 bp, Lactococcus lactis
  primer_bind (1)..(23): Primer 891
acagattaaaggttgaccagtau

SEQ ID NO: 170 - DNA, 20 bp, Lactococcus lactis
  primer_bind (1)..(20): Primer 892
accaattctgtgttgcgcau

SEQ ID NO: 171 - DNA, 95 bp, Lactococcus lactis
  primer_bind (1)..(95): Primer 893
  misc_feature (25)..(29): n is a, c, g, t or u
  misc_feature (45)..(58): n is a, c, g, t or u
  misc_feature (68)..(71): n is a, c, g, t or u
atgcgcaacacagaattgguggccnnnnnagtttattcttgacannnnnnnnnnnnnntgrtataatnnnnaagtaataaaatattcggaggaat

SEQ ID NO: 172 - DNA, 49 bp, Lactococcus lactis
  primer_bind (1)..(49): Primer 894
atactggtcaacctttaatctguttaaaatgctgataaaaacaattctt

SEQ ID NO: 173 - DNA, 22 bp, Lactococcus lactis
  primer_bind (1)..(22): Primer 920
ataagctugatatcgaattcct

SEQ ID NO: 174 - DNA, 22 bp, Lactococcus lactis
  primer_bind (1)..(22): Primer 921
attcccttuagtgagggttaat

SEQ ID NO: 175 - DNA, 38 bp, Lactococcus lactis
  primer_bind (1)..(38): Primer 926
tcgacctcgagttttttatttttagtttttaactgcag

SEQ ID NO: 176 - DNA, 21 bp, Lactococcus lactis
  primer_bind (1)..(21): Primer 927
atgtgtacgutctcctttgtg

SEQ ID NO: 177 - DNA, 32 bp, Lactococcus lactis
  primer_bind (1)..(32): Primer 928
acgtacacauattatagtatttggaaccgaac

SEQ ID NO: 178 - DNA, 27 bp, Lactococcus lactis
  primer_bind (1)..(27): Primer 929
aagcttauggtcgtcttgttacttgtg

SEQ ID NO: 179 - DNA, 28 bp, Lactococcus lactis
  primer_bind (1)..(28): Primer 930
aaagggaautctgccggagctatatatg

SEQ ID NO: 180 - DNA, 24 bp, Lactococcus lactis
  primer_bind (1)..(24): Primer 975
ttaattatacaacattcctccatc

SEQ ID NO: 181 - DNA, 32 bp, Lactococcus lactis
  primer_bind (1)..(32): Primer 976
aattcctgcagatctatacctacttgaccagc

SEQ ID NO: 182 - DNA, 30 bp, Lactococcus lactis
  primer_bind (1)..(30): Primer 977
tagtggatccgagtattcgcaaaccttcag

SEQ ID NO: 183 - DNA, 35 bp, Lactococcus lactis
  primer_bind (1)..(35): Primer 978
aattcctgcagaataaatgaatgaggtaaggtcta

SEQ ID NO: 184 - DNA, 34 bp, Lactococcus lactis
  primer_bind (1)..(34): Primer 979
gacctcgagtttaagagataaaaggttaattgtg

SEQ ID NO: 185 - DNA, 57 bp, Lactococcus lactis
  primer_bind (1)..(57): Primer 991
gaatcggtaccaataaaatattcggaggaattttgaaatgttacgtcctgtagaaac

SEQ ID NO: 186 - DNA, 68 bp, Lactococcus lactis
  primer_bind (1)..(68): Primer 992
ggaccgtacgttaaaaaataaaaaagaacccactcgggttcttttttttattgtttgcctccctgctg

SEQ ID NO: 187 - DNA, 30 bp, Lactococcus lactis
  primer_bind (1)..(30): Primer 1057
tagtggatcccttaattgctggaatcactg

SEQ ID NO: 188 - DNA, 35 bp, Lactococcus lactis
  primer_bind (1)..(35): Primer 1058
aattcctgcagatgatatttctcttttctatctca

SEQ ID NO: 189 - DNA, 35 bp, Lactococcus lactis
  primer_bind (1)..(35): Primer 1059
aattcctgcagaattgcttaaatttctttagctac

SEQ ID NO: 190 - DNA, 30 bp, Lactococcus lactis
  primer_bind (1)..(30): Primer 1060
tcgacctcgagttagacgctcgggataaag

SEQ ID NO: 191 - DNA, 18 bp, Lactococcus lactis
  primer_bind (1)..(18): Primer 1112
gcaacaacgtgcgcaaac

SEQ ID NO: 192 - DNA, 17 bp, Lactococcus lactis
  primer_bind (1)..(17): Primer 1113
ctgcaggtcgactctag

SEQ ID NO: 193 - DNA, 22 bp, Lactococcus lactis
  primer_bind (1)..(22): Primer 1117
aatattttaggacccaatgatg

SEQ ID NO: 194 - DNA, 20 bp, Lactococcus lactis
  primer_bind (1)..(20): Primer 1119
cgagctggaaagcttttatc

SEQ ID NO: 195 - DNA, 109 bp, Lactococcus lactis
  primer_bind (1)..(109): Primer 1130
  misc_feature (13)..(17): n is a, c, g, or t
  misc_feature (33)..(46): n is a, c, g, or t
  misc_feature (56)..(59): n is a, c, g, or t
ctagtctagagcnnnnnagtttattcttgacannnnnnnnnnnnnntgrtataatnnnnaagtaataaaatattcggaggaattttgaaatgaaactcgccgtttatag

SEQ ID NO: 196 - DNA, 32 bp, Lactococcus lactis
  primer_bind (1)..(32): Primer 1131
tcgacctcgagaagaatagaggatgaaaggtc

SEQ ID NO: 197 - DNA, 774 bp, Lactobacillus buchneri
  CDS (1)..(774): Lactobacillus buchneri gene encoding acetoin reductase
atggcaaagcaagttgcattagttactggagcaggtcagggaattggtgaagccatcgcgactcgtcttcacgatgatggattcaatgttgccgttgttgatttgaacatcgacaatgccaacaaggtagccaagaagctttcaccagatggttctgaatcgattggcatcaaggccgacgtttccgaccgtgattcagtcatcgctgctgtaaacaaagccgtagatgaattcggcgacttcaacgtaatcgtcaataacgctggtctggggccaacgacaccaatcgatacgattacccccgatcaatttaaactcgtgtatggtgtcaacgtaggtggtgttctgtggggcatccaagctgcacatcaagcatttaagaaattaggccatggcggcaagattatcaacgctacttcacaagctggcgttgtcggtaatccaaacttggcattgtactcaggcaccaagtttgcggttcgaggcatcacccaggtggctgcccgtgacttggcagaagaaggcatcaccgcaaatgcttatgcaccaggaatcgtaaaaacaccaatgatgtttgatatcgcgcatcaagtcggtaagaacgccggcaaggacgatgagtggggcatgcagacattcgcaaaggatattgccctcaaacgtttgtcggagccggaagatgtggcagcagctgtatcattcttggcaggtaaggattcaaattatgttaccggacaaacgctgatcgtggatggcggaatgcaatttcaatag

SEQ ID NO: 198 - protein, 257 aa, Lactobacillus buchneri
MAKQVALVTGAGQGIGEAIATRLHDDGFNVAVVDLNIDNANKVAKKLSPDGSESIGIKADVSDRDSVIAAVNKAVDEFGDFNVIVNNAGLGPTTPIDTITPDQFKLVYGVNVGGVLWGIQAAHQAFKKLGHGGKIINATSQAGVVGNPNLALYSGTKFAVRGITQVAARDLAEEGITANAYAPGIVKTPMMFDIAHQVGKNAGKDDEWGMQTFAKDIALKRLSEPEDVAAAVSFLAGKDSNYVTGQTLIVDGGMQFQ

SEQ ID NO: 199 - DNA, 771 bp, Lactobacillus buchneri
  CDS (1)..(771): Lactobacillus buchneri  gene encoding acetoin reductase
atggcaaaattagcaattgtaactggcgcaggacaaggaatcggagaaggcatcgctcatcgactggcaaaagatgggttcgcgattgcagtcgcagatatcaatggggaaacagctgataaggtaaccgcagacttgactaacgacggctacactgccaaatcgtatcatatcgacgtggctgaccgcgaacgggtctttgaattagtgcaaaaagcggttgccgatcttggtgagcttgccgtgtacgtcaataatgccggggtggctttcatcaacgaaattgttgattccgcggaaaaagacatccggcgattattggatgtcaatttattaggaacttattggggaacccaggcggcggccgaacaattcaaaaaacagggtcacggtggtcgaatcgttaacgcggcctccctggccggtgttgaggcatctgctctgcaaagcgcttattcgatttcaaagtttggcgttcggggaattactcaagcagcttcgaaggaattggcaaaggaccaaatcaccgttaacgcttacgatccaggaattgtcagaacacctctaagagacggcatcgacaaacggaccgctgaaatcaaaggaatctctgtcgctgaacaacaaaaaaactgcctcagtgaaatctcactgggcagagaagcgacaccagaagacgttgccaaagtcgtttcgtggtttgcatcccctgatgccgcttatatcaccggccaatcaattctagtggatggtggcatgagatatcaatag

SEQ ID NO: 200 - protein, 256 aa, Lactobacillus buchneri
MAKLAIVTGAGQGIGEGIAHRLAKDGFAIAVADINGETADKVTADLTNDGYTAKSYHIDVADRERVFELVQKAVADLGELAVYVNNAGVAFINEIVDSAEKDIRRLLDVNLLGTYWGTQAAAEQFKKQGHGGRIVNAASLAGVEASALQSAYSISKFGVRGITQAASKELAKDQITVNAYDPGIVRTPLRDGIDKRTAEIKGISVAEQQKNCLSEISLGREATPEDVAKVVSWFASPDAAYITGQSILVDGGMRYQ

SEQ ID NO: 201 - DNA, 426 bp, Lactococcus lactis
  CDS (1)..(426): LacA gene
atggctattgttgttggtgcagatctcaaaggtacgagattaaaagatgttgtgaaaaattttcttgtagaagaaggttttgaggtaattgatgtgactaaggacggacaagattttgttgatgttaccttggcagttgcctctgaagtaaataaagatgagcaaaacttaggtattgtaattgatgcttatggagctggtccattcatggtagcaactaaaattaaaggtatggttgcagcagaagtttcagatgaacgctcagcttatatgacacgtggacataacaatgcacgaatgattacggttggcgctgaaatcgtcggtgatgagcttgctaaaaacatcgctaaagctttcgtcaatggtaaatatgatggcggacgtcatcaagtccgagtagatatgcttaacaagatgtgttaa

SEQ ID NO: 202 - protein, 141 aa, Lactococcus lactis
MAIVVGADLKGTRLKDVVKNFLVEEGFEVIDVTKDGQDFVDVTLAVASEVNKDEQNLGIVIDAYGAGPFMVATKIKGMVAAEVSDERSAYMTRGHNNARMITVGAEIVGDELAKNIAKAFVNGKYDGGRHQVRVDMLNKMC

SEQ ID NO: 203 - DNA, 516 bp, Lactococcus lactis
  CDS (1)..(516): LacB gene
atgagaatcgcaattggatgtgaccacattgtcacagatgtaaaaatggcagtatcagaattcttgaaatcaaaaggatatgaggtccttgatttcgggacatatgaccacgtacgtactcactaccctatctatggtaaaaaagtcggtgaagcagtagtaagtggtcaagcagacttgggagtatgtatctgtggtacgggtgtcggcattaacaatgcagtcaataaagttccaggtgttcgctcagcgttggttcgtgatatgacgtcagctctatatgctaaggaagaacttaatgcgaatgttatcggttttggtggaatgattactggtggtcttcttatgaatgacatcattgaagctttcattgaagctgagtacaaaccaacagaagaaaataaaaaattgattgcaaaaatcgaacacgttgaaacacataatgcacatcaagcagatgaggaattctttacagaattccttgaaaaatgggaccgtggtgagtaccacgattaa

SEQ ID NO: 204 - protein, 171 aa, Lactococcus lactis
MRIAIGCDHIVTDVKMAVSEFLKSKGYEVLDFGTYDHVRTHYPIYGKKVGEAVVSGQADLGVCICGTGVGINNAVNKVPGVRSALVRDMTSALYAKEELNANVIGFGGMITGGLLMNDIIEAFIEAEYKPTEENKKLIAKIEHVETHNAHQADEEFFTEFLEKWDRGEYHD

SEQ ID NO: 205 - DNA, 933 bp, Lactococcus lactis
  CDS (1)..(933): LacC gene
atgattctgacagtcacactaaatccttcagtagacatctcttatcctctagaaacattgaaaattgatacagtgaatagggtgaaagatgttagtaagacagctggtggaaaaggcttaaatgttactagagtcttgtatgaatctggtgataaagttactgctacaggtttcttaggtggtaaaattggtgaatttattgaaagcgaattagaacaatctcctgttagtccagctttttataaaatctcaggaaacactagaaactgtattgctattttacacgagggtaaccaaacagaaattttggaacaaggaccaacaatttctcatgaagaagcagaaggctttcttgaccactatagcaatcttattaagcaatcagaagttgtcacaatttcaggaagtttgccttcaggacttcccaacgattattatgaaaaacttatccaacttgcttcggatgaaggagtagcagtcgttttggattgttcaggtgcaccacttgaaacagttctaaaatcgtcggctaaacctactgccatcaaacctaataatgaggaactttcacagttgcttggaaaagaagtaacaaaagatattgaagaactcaaagacgttcttaaagagtcactttttagtggtatcgaatggatagtggtctcattaggtcgaaacggtgcctttgcaaaacatggtgatgttttctataaggtagatattcctgatatcccagttgttaatccagtcggatcaggggactcaacggtagctggtattgcatcagctttaaatagtaaaaaaagtgacgctgacttattaaaacatgcgatgacattgggtatgttaaatgctcaagaaacaatgacagggcatgtgaatatgactaattacgaaacactaaactcacaaattggagtaaaagaggtataa

SEQ ID NO: 206 - protein, 310 aa, Lactococcus lactis
MILTVTLNPSVDISYPLETLKIDTVNRVKDVSKTAGGKGLNVTRVLYESGDKVTATGFLGGKIGEFIESELEQSPVSPAFYKISGNTRNCIAILHEGNQTEILEQGPTISHEEAEGFLDHYSNLIKQSEVVTISGSLPSGLPNDYYEKLIQLASDEGVAVVLDCSGAPLETVLKSSAKPTAIKPNNEELSQLLGKEVTKDIEELKDVLKESLFSGIEWIVVSLGRNGAFAKHGDVFYKVDIPDIPVVNPVGSGDSTVAGIASALNSKKSDADLLKHAMTLGMLNAQETMTGHVNMTNYETLNSQIGVKEV

SEQ ID NO: 207 - DNA, 981 bp, Lactococcus lactis
  CDS (1)..(981): LacD gene
atggtacttacagaacagaaacgcaaatctttggaaaaactttcagataaaaacggttttatctcagctttggcatttgaccaacgtggtgctttgaaacgtttgatggcacagtatcaagatacagaaccaactgtagctcaaatggaagaactaaaggttttggttgctgatgaacttacaaagtacgcttcttcaatgttgcttgaccctgaatatggacttccagcaacaaaagcattggataaagaagcaggtcttcttcttgcctatgaaaaaacaggttatgatacatcaagtacaaaacgtttgcctgactgcttggatgtttggtctgcaaagcgtatcaaagagcaaggcgctgatgccgttaagttcttgctttactatgatgtagacagctcagatgaacttaaccaacaaaaacaagcttatattgaacgtgttggttctgaatgtgtcgctgaagatattcctttcttcttggaaatccttgcttatgatgaagaaatctcagatgcaggttccgttgaatatgcaaaagtgaaacctcgcaaagtcattgaagcgatgaaagttttctctgatccacgctttaacattgatgttcttaaagtagaagtaccagttaacgttaaatatgtcgaaggttttgctgatggtgaagtggtttacagtaaagctgaagctgctgacttctttaaagcacaagaagaagcgactaaccttccatacatctacctaagtgcaggtgtatctgctaaattgttccaagaaacattgcaatttgctcacgactcaggtgccaagtttaatggtgtgctttgtggacgtgctacttgggcaggatctgtagaaccttacatcaaagaaggtgaaaaagcagcacgtgaatggttgcgtactactggattcgaaaatattgatgaacttaacaaagttcttgttaaaacagctagtccatggactgataaagtatag

SEQ ID NO: 208 - protein, 326 aa, Lactococcus lactis
MVLTEQKRKSLEKLSDKNGFISALAFDQRGALKRLMAQYQDTEPTVAQMEELKVLVADELTKYASSMLLDPEYGLPATKALDKEAGLLLAYEKTGYDTSSTKRLPDCLDVWSAKRIKEQGADAVKFLLYYDVDSSDELNQQKQAYIERVGSECVAEDIPFFLEILAYDEEISDAGSVEYAKVKPRKVIEAMKVFSDPRFNIDVLKVEVPVNVKYVEGFADGEVVYSKAEAADFFKAQEEATNLPYIYLSAGVSAKLFQETLQFAHDSGAKFNGVLCGRATWAGSVEPYIKEGEKAAREWLRTTGFENIDELNKVLVKTASPWTDKV

SEQ ID NO: 209 - DNA, 1707 bp, Lactococcus lactis
  CDS (1)..(1707): LacE gene
atgcataaactcattgaacttattgagaaagggaaaccattctttgagaaaatctctcgaaacatctatcttcgtgctattcgtgatggatttattgctggtatgccagtcatccttttctcatctatctttatccttattgcctatgtcccaaatgcttggggattccactggtcaaaagacattgagaccttcttgatgactccttatagctattcgatgggtatcctagcattctttgttggtggtactaccgctaaagctttgacggactcaaagaaccgtgacctacctgcgaccaatcagattaacttcttatctacgatgctagcgtctatggtagggttccttttgatggcagctgagcctgcaaaagaaggaggcttcttgacagccttcatgggaacaaaaggccttttgacagcatttatcgcagcctttgtgacagttaatgtttataaagtctgtgtaaaaaataatgttaccattcgtatgcctgaagatgttccaccaaatatctctcaagtatttaaggacttgattccgttcaccgtatcagttgttctcctatatggacttgaactccttgttaagggaactcttggtgtaactgttgcagaatcaatcggtacccttattgctcctcttttctcagctgcagatggttaccttggaattacacttatctttggtgcttatgccttcttctggtttgttggtattcacggtccttcaattgtcgaaccagcaatcgctgctatcacttatgccaatatcgatgtcaacttgcatcttatccaagctggacaacatgcagataaagttatcacttctggtactcaaatgtttattgctaccatgggtggaacaggagctacattgattgttccattcttgttcatgtggatttgtaaatcagatcgtaaccgtgccatcggacgtgcctcagttgttccaacattctttggggttaatgagccaatcttatttggtgcaccaatcgtattgaatccgattttctttgtaccgttcattttcgctccgattgtcaacgtttggatctttaaattctttgttgacacattgaacatgaactcattctctgccaaccttccatgggttactcctggtccgttgggaattgtactcggtactaacttccaagttctatcatttatcttagccggactcttggtagttgttgatactatcatttattacccatttgttaaggtatacgatgaacaaattcttgaagaagaacgttctggtaaaacaaacgatgctcttaaagaaaaagtagctgcaaacttcaatactgctaaagcagatgccgttcttggaaaagcagacgttgctaaagaagatgtagcagcaaacaataatatcacaaaagaaactaatgtccttgttctttgtgcaggtggaggtacaagtggcttgcttgccaatgccttgaacaaagcagcagcagaatacaatgttccagtcaaggcggcagcgggtggttacggtgctcaccgtgaaatgttgccagagtttgacttggtaatcttggctccacaggtcgcttcaaacttcgatgatatgaaggctgaaacagataaattgggcattaaacttgtaaaaactgaaggagctcaatatatcaaattgacacgtgacggacaaggtgctcttgcatttgttcaacaacagtttgattaa

SEQ ID NO: 210 - protein, 568 aa, Lactococcus lactis
MHKLIELIEKGKPFFEKISRNIYLRAIRDGFIAGMPVILFSSIFILIAYVPNAWGFHWSKDIETFLMTPYSYSMGILAFFVGGTTAKALTDSKNRDLPATNQINFLSTMLASMVGFLLMAAEPAKEGGFLTAFMGTKGLLTAFIAAFVTVNVYKVCVKNNVTIRMPEDVPPNISQVFKDLIPFTVSVVLLYGLELLVKGTLGVTVAESIGTLIAPLFSAADGYLGITLIFGAYAFFWFVGIHGPSIVEPAIAAITYANIDVNLHLIQAGQHADKVITSGTQMFIATMGGTGATLIVPFLFMWICKSDRNRAIGRASVVPTFFGVNEPILFGAPIVLNPIFFVPFIFAPIVNVWIFKFFVDTLNMNSFSANLPWVTPGPLGIVLGTNFQVLSFILAGLLVVVDTIIYYPFVKVYDEQILEEERSGKTNDALKEKVAANFNTAKADAVLGKADVAKEDVAANNNITKETNVLVLCAGGGTSGLLANALNKAAAEYNVPVKAAAGGYGAHREMLPEFDLVILAPQVASNFDDMKAETDKLGIKLVKTEGAQYIKLTRDGQGALAFVQQQFD

SEQ ID NO: 211 - DNA, 318 bp, Lactococcus lactis
  CDS (1)..(318): LacF gene
atgaacagagaagagatgactctcttagggtttgaaattgttgcttatgctggagatgctcgctctaagcttttagaagcgcttaaagcggctgaaaatggtgatttcgctaaggcagatagtcttgtagtagaagcaggaagctgtattgcagaggctcacagttctcagacaggtatgttggctcgagaagcttctggggaggaacttccatacagtgttactatgatgcatggtcaggatcacttgatgactacgatcttattaaaagatgtgattcatcacctcatcgaactttataaaagaggagcaaagtaa

SEQ ID NO: 212 - protein, 105 aa, Lactococcus lactis
MNREEMTLLGFEIVAYAGDARSKLLEALKAAENGDFAKADSLVVEAGSCIAEAHSSQTGMLAREASGEELPYSVTMMHGQDHLMTTILLKDVIHHLIELYKRGAK

SEQ ID NO: 213 - DNA, 1407 bp, Lactococcus lactis
  CDS (1)..(1407): LacG gene
atgactaaaacacttcctaaagattttatttttggtggtgctacagctgcttatcaagcagaaggtgcaactcacacagatggtaagggcccagtagcatgggataagtatcttgaagacaattattggtatacagcagaacctgcaagtgatttttaccataaatacccagttgatttagaattagctgaagaatatggtgttaatggtattcgtatttctattgcctggtctcgtattttcccaacgggttacggtgaagtaaatgaaaaaggtgttgaattctaccataaactatttgctgaatgccacaagcgtcatgttgaaccatttgtgactttgcatcattttgacacaccagaagctcttcattcaaatggagatttcttaaaccgcgaaaatatagaacactttatagattatgccgctttctgttttgaagagtttccagaagtaaactactggacaactttcaatgaaattggcccaattggtgatggtcaatacttggttggtaaattccctccaggcattaaatatgatcttgccaaagtcttccaatcacaccacaacatgatggtctctcatgcacgtgctgtaaaattgtataaggataaaggttataaaggtgaaattggtgttgttcatgctttaccaactaaatacccttatgatccggaaaatccagcagatgttcgtgctgctgaacttgaagacatcatccataacaaatttatcttggatgcaacctatcttgggcactattcagataaaacgatggaaggtgtcaaccatatcctagctgagaatggtggagaacttgatcttcgtgatgaagacttccaagctcttgacgcagctaaagatttgaatgatttccttggtatcaactattacatgagtgattggatgcaagcttttgatggtgagactgaaatcattcacaatggtaagggtgaaaaaggaagctctaagtaccaaattaagggtgttggtcgtcgagtagctcctgactatgttccgcgcacagactgggattggattatttatcctgaaggcttgtatgaccaaatcatgcgagtgaaaaatgattatccgaattacaagaagatttacatcactgaaaacggtctcggatacaaagatgagtttgtagataatactgtttatgatgatggtcgtattgattacgtgaagcaacacttggaagttttatcagacgcgattgcggatggtgcaaatgttaaaggttacttcatttggtcacttatggacgttttctcatggtcaaatggttatgaaaaacgttatggattgttctatgtagactttgatacgcaagaacgctatcctaagaaatcagcacattggtataagaaattagcagaaactcaagtgatagagtaa

SEQ ID NO: 214 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 215 - DNA, 768 bp, Lactococcus lactis
  CDS (1)..(768): LacR gene
atgaacaaaaaacgacgattagaaaaaattttagatatgttaaagattgatgggaccataaccataaaagaaataatagatgaactagatatttccgatatgacagcccgtagagaccttgatgctctagaagctgatggacttttaacacgtactcatggtggtgcacaattgctttcctctaaaaagccacttgaaaagacacatatcgagaagaaaagtctaaatacaaaagaaaaaattgacattgctaaaaaagcctgctctttaatcaaagatggcgatactatttttattggacccggaactacacttgtacaactggcattagaattgaaaggtcgtaaaggttataaaattcgtgtcattacaaatagtctccctgtgttcttgattctaaatgatagcgaaaccattgatttattgcttcttggcggtgaatatagagaaataactggagcttttgtaggttcaatggcttcgacaaatttaaaagcaatgagatttgccaaagcttttgttagtgcaaatgctgttacccataattctattgctacatatagtgacaaggaaggtgtgattcaacaacttgccctaaacaatgctgtagaaaaattcttattagtagacagtactaaattcgatcgatacgatttctttaacttctacaatctagatcaactcgataccatcattacagataaccagattagccctcaacacttagaggaatttagccagtacactactattttaaaagcggactag

SEQ ID NO: 216 - protein, 255 aa, Lactococcus lactis
MNKKRRLEKILDMLKIDGTITIKEIIDELDISDMTARRDLDALEADGLLTRTHGGAQLLSSKKPLEKTHIEKKSLNTKEKIDIAKKACSLIKDGDTIFIGPGTTLVQLALELKGRKGYKIRVITNSLPVFLILNDSETIDLLLLGGEYREITGAFVGSMASTNLKAMRFAKAFVSANAVTHNSIATYSDKEGVIQQLALNNAVEKFLLVDSTKFDRYDFFNFYNLDQLDTIITDNQISPQHLEEFSQYTTILKAD

The invention claimed is:

1. A genetically modified lactic acid bacterium for production of diacetyl, wherein the genome of said lactic acid bacterium is deleted for all of the genes or lacks all of the endogenous genes encoding polypeptides having an enzymatic activity of:
   a. lactate dehydrogenase having E.C.1.1.1.27 or E.C.1.1.1.28;
   b. α-acetolactate decarboxylase having E.C. 4.1.1.5;
   c. phosphotransacetylase having E.C.2.3.1.8;
   d. NADH oxidase having E.C. 1.6.3.4;
   e. alcohol dehydrogenase having E.C. 1.2.1.10; and
   f. a butanediol dehydrogenase having E.C. 1.1.1.4; and
   wherein said microorganism is devoid of transgenes encoding polypeptides having an enzymatic activity of:
   g. a (S)-acetoin forming diacetyl reductase having E.C.1.1.1.304; and
   h. a L-butanediol dehydrogenase having E.C. 1.1.1.76,
   wherein the lactic acid bacteria belongs to a genus selected from the group consisting of Lactococcus, Lactobacillus, Pediococcus, Leuconostoc, Streptococcus, Oenococcus, and Bacillus.

2. A genetically modified lactic acid bacterium according to claim 1, wherein the genome of said lactic acid bacterium is additionally deleted for one or more genes or lacks one or more genes encoding polypeptides having an enzymatic activity selected from the group of:
   i. a (R)-acetoin forming diacetyl reductase having E.C.1.1.1.303; and
   j. D-acetoin reductase.

3. A genetically modified lactic acid bacterium according to claim 1, wherein the lactic acid bacteria belongs to the genus Lactococcus.

4. A genetically modified lactic acid bacterium according to claim 1, wherein:
   a. the amino acid sequence of the polypeptide having lactate dehydrogenase activity has at least 80% sequence identity to an amino acid sequence selected from among SEQ ID NO: 2, 4, 6, 8, 10, 12, 14, 16, 18, 20, 22, 24, 26, 28, 30, 32, 34 and 36.

5. A genetically modified lactic acid bacterium according to claim 1, wherein:
   a. the amino acid sequence of the polypeptide having phosphotransacetylase activity has at least 80% sequence identity to an amino acid sequence selected from among SEQ ID NO: 42, 44, 46, 48, 50, 52, 54, 56, 58 and 60.

6. A genetically modified lactic acid bacterium according to claim 1, wherein the amino acid sequence of the polypeptide having α-acetolactate decarboxylase activity has at least 80% sequence identity to an amino acid sequence selected from among SEQ ID NO:80, 82, 84, 86, 88, 90, 92, 94 and 96.

7. A genetically modified lactic acid bacterium according to claim 2, wherein:

a. the amino acid sequence of the polypeptide having alcohol dehydrogenase activity has at least 80% sequence identity to an amino acid sequence selected from among SEQ ID NO: 62, 64, 66, 68, 70, 72, 74, 76 and 78;
b. the amino acid sequence of the polypeptide having diacetyl reductase having E.C.1.1.1.303 activity has at least 80% sequence identity to SEQ ID NO: 98;
c. the amino acid sequence of the polypeptide having D-acetoin reductase activity has at least 80% sequence identity to SEQ ID NO: 100, 102, 104, 106 108, 110 and 112; and
d. the amino acid sequence of the polypeptide having butanediol dehydrogenase having E.C.1.1.1.4 activity has at least 80% sequence identity to SEQ ID NO: 114.

8. A genetically modified lactic acid bacterium according to claim 1, wherein the amino acid sequence of the polypeptide having a NADH oxidase activity has at least 80% sequence identity to an amino acid sequence selected from among SEQ ID NO: 116, 118, 120, 122, 124, 126, 128, 130, 132, 134 and 136.

9. A genetically modified lactic acid bacterium according to claim 1, wherein the genome of said lactic acid bacterium comprises genes encoding polypeptides having:
k. lactose-specific phosphotransferase system (PTS) activity having EC 2.7.1.69;
l. phospho-β-D-galactosidase activity having EC 3.2.1.85;
m. galactose-6-phosphate isomerase activity having EC 5.3.1.26;
n. D-tagatose-6-phosphate kinase activity having EC 2.7.1.114; and
o. tagatose 1,6-diphosphate aldolase activity having EC 4.1.2.40.

10. A genetically modified lactic acid bacterium according to claim 9, wherein:
a. the lactose-specific phosphotransferase system (PTS) activity having EC 2.7.1.69 is provided by a first and a second polypeptide, wherein the amino acid sequence of the first polypeptide has at least 80% sequence identity to an amino acid sequence of SEQ ID NO: 210, and the amino acid sequence of the second polypeptide has at least 80% sequence identity to an amino acid sequence of SEQ ID NO: 212;
b. the amino acid sequence of the polypeptide having phospho-β-D-galactosidase activity having EC 3.2.1.85 has at least 80% sequence identity to an amino acid sequence of SEQ ID NO: 214;
c. the amino acid sequence of the polypeptide having galactose-6-phosphate isomerase activity having EC 5.3.1.26 is provided by a first and a second polypeptide, wherein the amino acid sequence of the first polypeptide has at least 80% sequence identity to an amino acid sequence of SEQ ID NO: 202 and the amino acid sequence of the second polypeptide has at least 80% sequence identity to an amino acid sequence of SEQ ID NO: 204;
d. the amino acid sequence of the polypeptide having D-tagatose-6-phosphate kinase activity having EC 2.7.1.114 has at least 80% sequence identity to an amino acid sequence of SEQ ID NO: 206; and
e. the amino acid sequence of the polypeptide having tagatose 1,6-diphosphate aldolase activity having EC 4.1.2.40 has at least 80% sequence identity to an amino acid sequence of SEQ ID NO: 208.

11. A method for the production of diacetyl, comprising the steps of:
a. introducing a genetically modified lactic acid bacterium according to claim 1 into a growth medium to produce a culture, wherein the growth medium comprises a source of protoporphyrin IX or iron-containing porphyrin;
b. cultivating the culture of (a) under aerobic growth conditions;
c. recovering diacetyl produced by said culture; and optionally
d. isolating the recovered diacetyl.

12. A method for the production of diacetyl according to claim 11, wherein the source of iron-containing porphyrin is hemin or hematin, wherein the concentration of hemin or hematin is 0.3- 5 µg/ml of the growth medium.

13. A method for the production of diacetyl according to claim 11, wherein the combined total $Fe^{2+}$, $Fe^{3+}$ and $Cu^{2+}$ concentration of the growth medium in step (a) is less than 20 mM.

14. A method for the production of diacetyl according to claim 11, including an additional step of supplementing the culture produced in step (b) with one or more metal ions selected from the group consisting of $Fe^{2+}$, $Fe^{3+}$ and $Cu^{2+}$; and incubating the supplemented culture under aerobic conditions prior to step (c).

15. A method for the production of diacetyl according to claim 11, wherein the growth medium comprises a source of lactose, such as whey, whey permeate or residual whey permeate.

* * * * *